(12) United States Patent
Gaertner

(10) Patent No.: US 9,133,406 B2
(45) Date of Patent: Sep. 15, 2015

(54) PRODUCTION OF FATTY ACID DERIVATIVES

(75) Inventor: Alfred Gaertner, South San Francisco, CA (US)

(73) Assignee: REG Life Sciences, LLC, South San Francisco, CA (US)

( * ) Notice: Subject to any disclaimer, the term of this patent is extended or adjusted under 35 U.S.C. 154(b) by 496 days.

(21) Appl. No.: 12/889,066

(22) Filed: Sep. 23, 2010

(65) Prior Publication Data

US 2011/0072714 A1    Mar. 31, 2011

Related U.S. Application Data

(60) Provisional application No. 61/245,943, filed on Sep. 25, 2009.

(51) Int. Cl.

| | |
|---|---|
| *C12P 7/64* | (2006.01) |
| *C12N 9/10* | (2006.01) |
| *C12N 15/00* | (2006.01) |
| *C12N 1/20* | (2006.01) |
| *C07H 21/04* | (2006.01) |
| *C10L 1/02* | (2006.01) |
| *C12N 15/63* | (2006.01) |
| *C10L 1/19* | (2006.01) |
| *C11C 3/10* | (2006.01) |
| *C12N 1/36* | (2006.01) |

(52) U.S. Cl.
CPC . *C10L 1/026* (2013.01); *C10L 1/19* (2013.01); *C11C 3/10* (2013.01); *C12N 1/36* (2013.01); *C12N 9/1029* (2013.01); *C12N 15/63* (2013.01); *C12P 7/649* (2013.01); *Y02E 50/13* (2013.01)

(58) Field of Classification Search
CPC ........ C12N 9/1029; C12N 15/63; C12P 7/649
See application file for complete search history.

(56) References Cited

U.S. PATENT DOCUMENTS

| | | | |
|---|---|---|---|
| 7,897,369 B2* | 3/2011 | Schmidt-Dannert et al. . | 435/134 |
| 2004/0009576 A1 | 1/2004 | Kalscheuer et al. | |
| 2005/0130126 A1 | 6/2005 | Durmaz et al. | |
| 2009/0006430 A1 | 1/2009 | Steinglass et al. | |
| 2009/0075333 A1 | 3/2009 | Campbell et al. | |
| 2009/0117629 A1 | 5/2009 | Schmidt-Dannert et al. | |
| 2009/0180987 A1 | 7/2009 | Stritzker et al. | |
| 2010/0071259 A1* | 3/2010 | Hu et al. ......................... | 44/388 |
| 2010/0257778 A1* | 10/2010 | Gaertner et al. ................ | 44/388 |
| 2011/0162259 A1* | 7/2011 | Gaertner ......................... | 44/385 |

FOREIGN PATENT DOCUMENTS

| | | |
|---|---|---|
| WO | WO-2007136762 A2 | 11/2007 |
| WO | WO-2008119082 | 10/2008 |
| WO | WO-2009006430 A1 | 1/2009 |

OTHER PUBLICATIONS

Holtzapple et al. Biosynthesis of isoprenoid wax ester in *Marinobacter hydrocarbonoclasticus* DSM 8798: identification and characterization of isoprenoid coenzyme A synthetase and wax ester synthases. J Bacteriol. May 2007;189(10):3804-12. Epub Mar. 9, 2007.*
Kalscheuer et al., Natural lipid biosynthesis in engineered *Escherichia coli*: jojoba oil-like wax esters and fatty acid butyl esters. Appl. Environ. Microbiol., vol. 72(2): 1373-1379 (Feb. 2006).
International Search Report issued for PCT/US10/50026, mailed on Jan. 6, 2011 (1 page).
Bowie et al., "Deciphering the Message in Protein Sequences: Tolerance to Amino Acid Substitutions," Science vol. 247: 1306-1310 (1990).
Knothe et al., "Dependence of biodiesel fuel properties on the structure of fatty acid alkyl esters," Fuel Processing Technology, vol. 86: 1059-1070 (2005).
Heath et al., Prog. Lipid Res. 40(6): 467-97 (2001).
Rock et al., "Increased Unsaturated Fatty Acid Production Associated with a Suppressor of the fabA6(ts) Mutation in *Escherichia coli*," J. Bacteriol., vol. 178(18): 5382-5387 (Sep. 1996(.
Mayer, K. and Shanklin, J. "Identification of amino acid residues involved in substrate specificity of plant acyl-ACP thioesterases using a bioinformatics-guided approach," BMC Plan Biology, vol. 7(1): 1-11 (2007).
Shockey, J.M. et al., "*Arabidopsis* Contains Nine Long-Chain Acyl-Coenzyme a Synthetase Genes That Partipate in Fatty Acid and Glycerolipid Metabolism," Plan. Phsiol. 129: 1710-1722 (2002).
Caviglia, J.M. et al., "Rat Long Chain Acyl-CoA Synthetase 5, but Not 1, 2, 3, or 4, Complements *Escherichia coli* fadD," J. Biol. Chem., vol. 279(12): 11163-1169 (2004).
Knoll et al., "Biochemical Studies of Three *Saccharomyces cerevisiae* Acyl-CoA Synthetases, Faa1p, Faa2p, and Faa3p," J. Biol. Chem., vol. 269(23): 16348-56 (1994).
Johnson et al., "Genetic Analysis of the Role of *Saccharomyces cerevisiae* Acyl-Coa Synthetase Genes in Regulating Protein N-Myristoylation," J. Biol. Chem., vol. 269 (27): 18037-18046 (1994).
International Search Report issued for PCT/US10/50024, mailed on Jan. 27, 2011 (1 page).

* cited by examiner

*Primary Examiner* — Yong Pak
(74) *Attorney, Agent, or Firm* — Brigitte Hajos

(57) ABSTRACT

Methods and compositions for producing fatty acid derivatives, for example, fatty esters, and commercial fuel compositions comprising fatty acid derivatives are described.

12 Claims, 66 Drawing Sheets

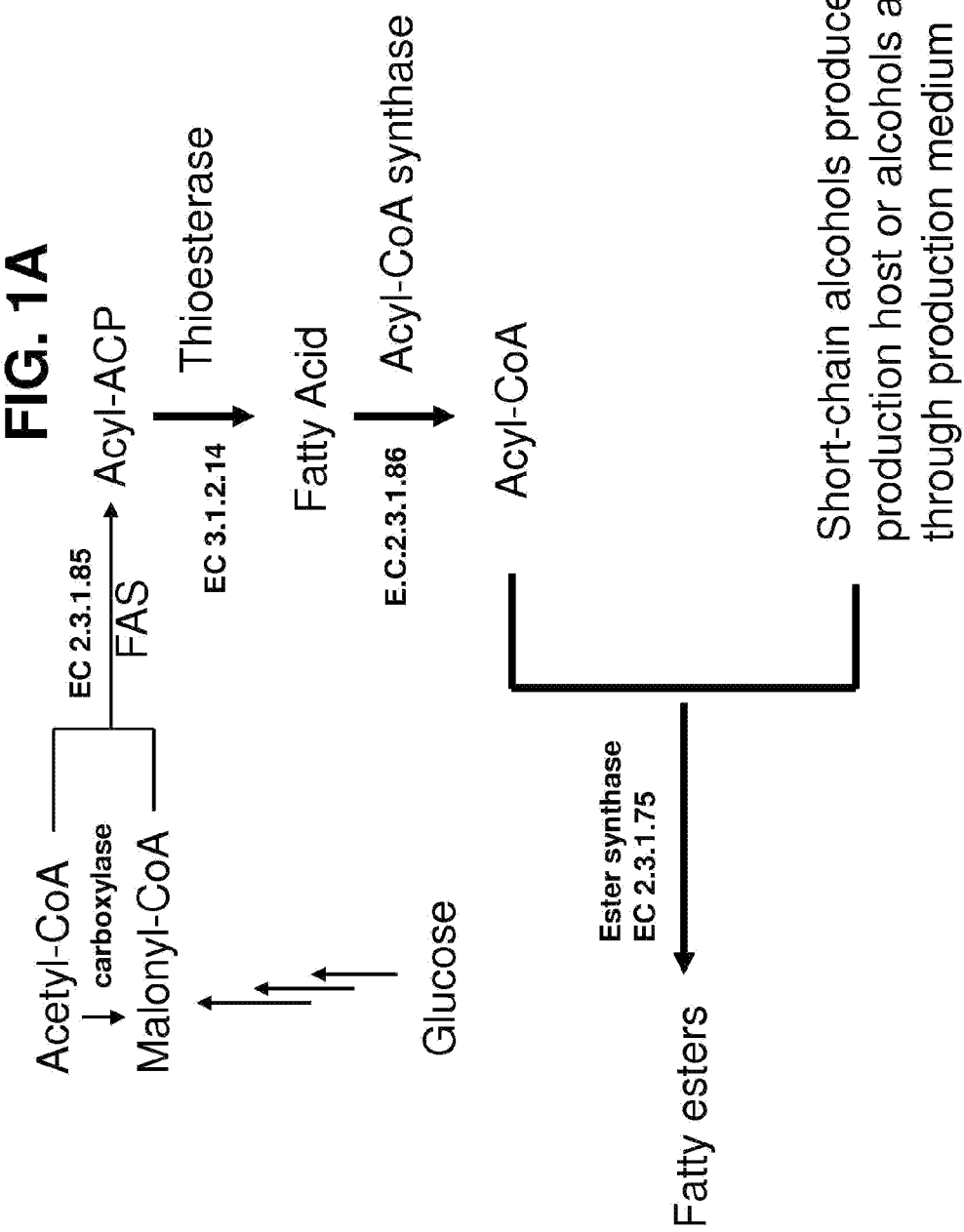

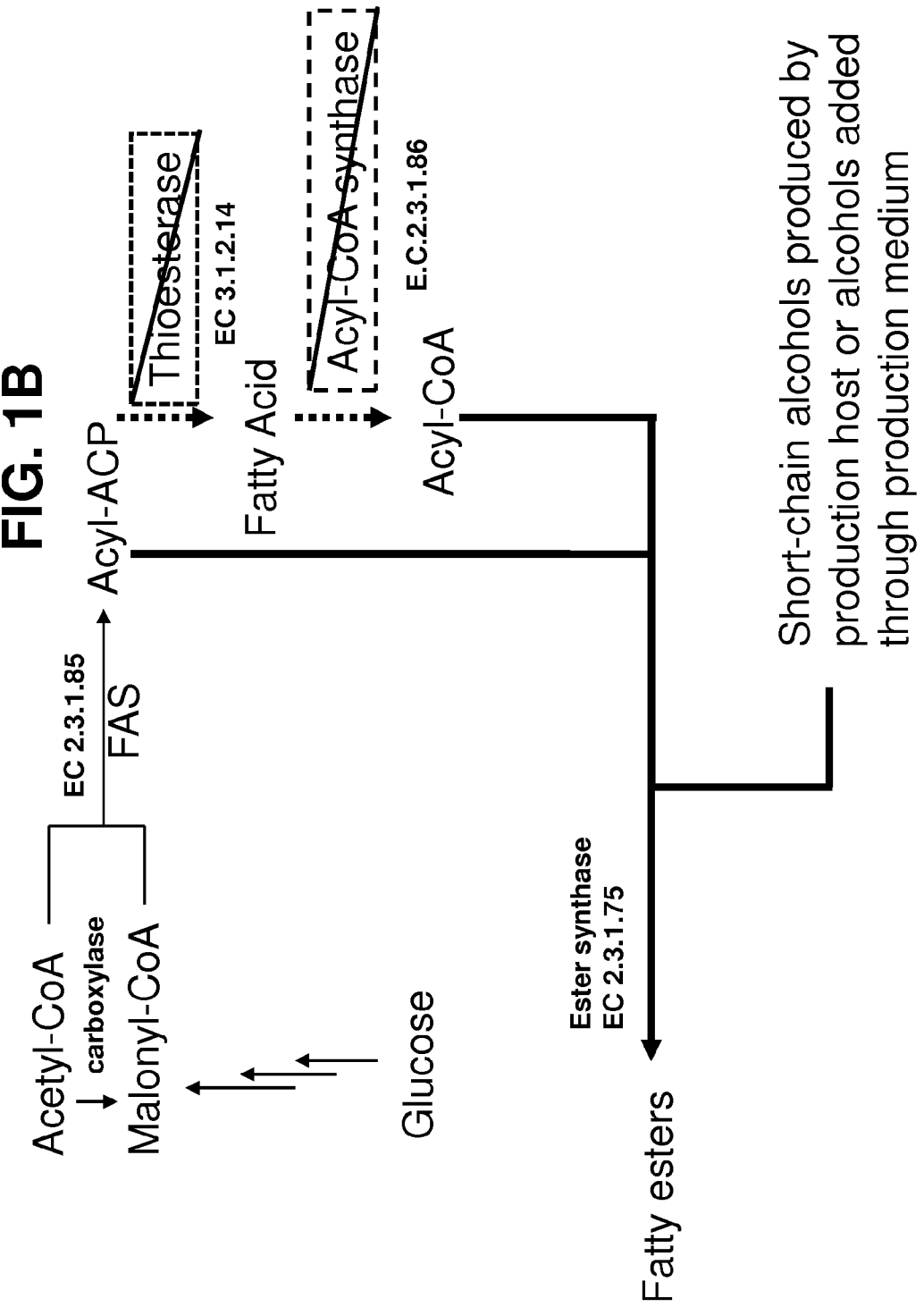

FIG. 2
E.coli spc ribosomal protein operon promoter Pspc

SEQ ID NO: 13

```
5'-gctgtttCAGTACACTCTCTCAATACGAATAAACGGCTCAGAAATGAGCCGT
TTATTTTTCTACCCATATCCTTGAAGCGGTGTTATAATGCCGCGCCCTCGATAT
GGGGATTTTTAACGACCTGATTTTCGGGTCTCAGTAGTAGTTGACATTAGCGGAG
CACTAAA-3'
```

FIG. 3
pDS33.ES9 plasmid

SEQ ID NO: 22

5'-CACTATACCAATTGAGATGGGCTAGTCAATGATAATTACTAGTCCTTTTCCTTTGA
GTTGTGGGTATCTGTAAATTCTGCTAGACCTTTGCTGGAAAACTTGTAAATTCTGCTA
GACCCTCTGTAAATTCCGCTAGACCTTTGTGTGTTTTTTTTGTTTATATTCAAGTGGTT
ATAATTTATAGAATAAAGAAAGAATAAAAAAAGATAAAAAGAATAGATCCCAGCCC
TGTGTATAACTCACTACTTTAGTCAGTTCCGCAGTATTACAAAAGGATGTCGCAAAC
*GCTGTTTCAGTACACTCTCTCAATACGAATAAACGGCTCAGAAATGAGCCGTTTATTTTTC*
*TACCCATATCCTTGAAGCGGTGTTATAATGCCGCGCCCTCGATATGGGATTTTTAACGAC*
*CTGATTTTCGGGTCTCAGTAGTAGTTGACATTAGCGGAGCACTAAACC*ATGAAACGTCT
CGGAACCCTGGACGCCTCCTGGCTGGCGGTTGAATCTGAAGACACCCCGATGC
ATGTGGGTACGCTTCAGATTTTCTCACTGCCGGAAGGCGCACCAGAAACCTTC
CTGCGTGACATGGTCACTCGAATGAAAGAGGCCGGCGATGTGGCACCACCCTG
GGGATACAAACTGGCCTGGTCTGGTTTCCTCGGGCGCGTGATCGCCCCGGCCT
GGAAAGTCGATAAGGATATCGATCTGGATTATCACGTCCGGCACTCAGCCCTG
CCTCGCCCCGGCGGGGAGCGCGAACTGGGTATTCTGGTATCCCGACTGCACTC
TAACCCCCTGGATTTTTCCCGCCCTCTTTGGGAATGCCACGTTATTGAAGGCCT
GGAGAATAACCGTTTTGCCCTTTACACCAAAATGCACCACTCGATGATTGACGG
CATCAGCGGCGTGCGACTGATGCAGAGGGTGCTCACCACCGATCCCGAACGCT
GCAATATGCCACCGCCCTGGACGGTACGCCCACACCAACGCCGTGGTGCAAAA
ACCGACAAAGAGGCCAGCGTGCCCGCAGCGGTTTCCCAGGCAATGGACGCCCT
GAAGCTCCAGGCAGACATGGCCCCAGGCTGTGGCAGGCCGGCAATCGCCTG
GTGCATTCGGTTCGACACCCGGAAGACGGACTGACCGCGCCCTTCACTGGACC
GGTTTCGGTGCTCAATCACCGGGTTACCGCGCAGCGACGTTTTGCCACCCAGC
ATTATCAACTGGACCGGCTGAAAAACCTGGCCCATGCTTCCGGCGGTTCCTTG
AACGACATCGTGCTTTACCTGTGTGGCACCGCATTGCGGCGCTTTCTGGCTGA
GCAGAACAATCTGCCAGACACCCCGCTGACGGCTGGTATACCGGTGAATATCC
GGCCGGCAGACGACGAGGGTACGGGCACCCAGATCAGTTTTATGATTGCCTCG
CTGGCCACCGACGAAGCTGATCCGTTGAACCGCCTGCAACAGATCAAAACCTC
GACCCGACGGGCCAAGGAGCACCTGCAGAAACTTCCAAAAAGTGCCCTGACCC
AGTACACCATGCTGCTGATGTCACCCTACATTCTGCAATTGATGTCAGGTCTCG
GGGGGAGGATGCGACCAGTCTTCAACGTGACCATTTCCAACGTGCCCGGCCCG
GAAGGCACGCTGTATTATGAAGGAGCCCGGCTTGAGGCCATGTATCCGGTATC
GCTAATCGCTCACGGCGGCGCCCTGAACATCACCTGCCTGAGCTATGCCGGAT
CGCTGAATTTCGGTTTTACCGGCTGTCGGGATACGCTGCCGAGCATGCAGAAA
CTGGCGGTTTATACCGGTGAAGCTCTGGATGAGCTGgAATCGCTGATTCTGCCA
CCCAAGAAGCGCGCCCGAACCCGCAAGTAACTCGAGATCTGCAGCTGGTACCATA
TGGGaattcACCCGCTGACGAGCTTAGTAAAGCCCTCGCTAGATTTTAATGCGGATGTT
GCGATTACTTCGCCAACTATTGCGATAACAAGAAAAGCCAGCCTTTCATGATATAT
CTCCCAATTTGTGTAGGGCTTATTATGCACGCTTAAAAATAATAAAAGCAGACTTGA
CCTGATAGTTTGGCTGTGAGCAATTATGTGCTTAGTGCATCTAACGCTTGAGTTAAG
CCGCGCCGCGAAGCGGCGTCGGCTTGAACGAATTGTTAGACATTATTTGCCGACTAC

FIG. 3 Cont.

```
CTTGGTGATCTCGCCTTTCACGTAGTGGACAAATTCTTCCAACTGATCTGCGCGCGA
GGCCAAGCGATCTTCTTCTTGTCCAAGATAAGCCTGTCTAGCTTCAAGTATGACGGG
CTGATACTGGGCCGGCAGGCGCTCCATTGCCCAGTCGGCAGCGACATCCTTCGGCGC
GATTTTGCCGGTTACTGCGCTGTACCAAATGCGGGACAACGTAAGCACTACATTTCG
CTCATCGCCAGCCCAGTCGGGCGGCGAGTTCCATAGCGTTAAGGTTTCATTTAGCGC
CTCAAATAGATCCTGTTCAGGAACCGGATCAAAGAGTTCCTCCGCCGCTGGACCTAC
CAAGGCAACGCTATGTTCTCTTGCTTTTGTCAGCAAGATAGCCAGATCAATGTCGAT
CGTGGCTGGCTCGAAGATACCTGCAAGAATGTCATTGCGCTGCCATTCTCCAAATTG
CAGTTCGCGCTTAGCTGGATAACGCCACGGAATGATGTCGTCGTGCACAACAATGGT
GACTTCTACAGCGCGGAGAATCTCGCTCTCTCCAGGGGAAGCCGAAGTTTCCAAAA
GGTCGTTGATCAAAGCTCGCCGCGTTGTTTCATCAAGCCTTACGGTCACCGTAACCA
GCAAATCAATATCACTGTGTGGCTTCAGGCCGCCATCCACTGCGGAGCCGTACAAAT
GTACGGCCAGCAACGTCGGTTCGAGATGGCGCTCGATGACGCCAACTACCTCTGAT
AGTTGAGTCGATACTTCGGCGATCACCGCTTCCCTCATGATGTTTAACTTTGTTTTAG
GGCGACTGCCCTGCTGCGTAACATCGTTGCTGCTCCATAACATCAAACATCGACCCA
CGGCGTAACGCGCTTGCTGCTTGGATGCCCGAGGCATAGACTGTACCCCAAAAAAA
CAGTCATAACAAGCCATGAAAACCGCCACTGCGCCGTTACCACCGCTGCGTTCGGTC
AAGGTTCTGGACCAGTTGCGTGAGCGCATACGCTACTTGCATTACAGCTTACGAACC
GAACAGGCTTATGTCCACTGGGTTCGTGCCTTCATCCGTTTCCACGGTGTGCGTCACC
CGGCAACCTTGGGCAGCAGCGAAGTCGAGGCATTTCTGTCCTGGCTGGCGAACGAG
CGCAAGGTTTCGGTCTCCACGCATCGTCAGGCATTGGCGGCCTTGCTGTTCTTCTACG
GCAAGGTGCTGTGCACGGATCTGCCCTGGCTTCAGGAGATCGGAAGACCTCGGCCG
TCGCGGCGCTTGCCGGTGGTGCTGACCCCGGATGAAGTGGTTCGCATCCTCGGTTTT
CTGGAAGGCGAGCATCGTTTGTTCGCCCAGCTTCTGTATGGAACGGGCATGCGGATC
AGTGAGGGTTTGCAACTGCGGGTCAAGGATCTGGATTTCGATCACGGCACGATCATC
GTGCGGGAGGGCAAGGGCTCCAAGGATCGGGCCTTGATGTTACCCGAGAGCTTGGC
ACCCAGCCTGCGCGAGCAGGGGAATTAATTCCCACGGGTTTTGCTGCCCGCAAACG
GGCTGTTCTGGTGTTGCTAGTTTGTTATCAGAATCGCAGATCCGGCTTCAGCCGGTTT
GCCGGCTGAAAGCGCTATTTCTTCCAGAATTGCCATGATTTTTCCCCACGGGAGGC
GTCACTGGCTCCCGTGTTGTCGGCAGCTTTGATTCGATAAGCAGCATCGCCTGTTTCA
GGCTGTCTATGTGTGACTGTTGAGCTGTAACAAGTTGTCTCAGGTGTTCAATTTCATG
TTCTAGTTGCTTTGTTTTACTGGTTTCACCTGTTCTATTAGGTGTTACATGCTGTTCAT
CTGTTACATTGTCGATCTGTTCATGGTGAACAGCTTTGAATGCACCAAAAACTCGTA
AAAGCTCTGATGTATCTATCTTTTTTACACCGTTTTCATCTGTGCATATGGACAGTTT
TCCCTTTGATATGTAACGGTGAACAGTTGTTCTACTTTTGTTTGTTAGTCTTGATGCTT
CACTGATAGATACAAGAGCCATAAGAACCTCAGATCCTTCCGTATTTAGCCAGTATG
TTCTCTAGTGTGGTTCGTTGTTTTGCGTGAGCCATGAGAACGAACCATTGAGATCAT
ACTTACTTTGCATGTCACTCAAAAATTTTGCCTCAAAACTGGTGAGCTGAATTTTTGC
AGTTAAAGCATCGTGTAGTGTTTTCTTAGTCCGTTATGTAGGTAGGAATCTGATGTA
ATGGTTGTTGGTATTTTGTCACCATTCATTTTATCTGGTTGTTCTCAAGTTCGGTTAC
GAGATCCATTTGTCTATCTAGTTCAACTTGGAAAATCAACGTATCAGTCGGGCGGCC
TCGCTTATCAACCACCAATTTCATATTGCTGTAAGTGTTTAAATCTTTACTTATTGGT
TTCAAAACCCATTGGTTAAGCCTTTTAAACTCATGGTAGTTATTTTCAAGCATTAACA
```

FIG. 3 Cont.

TGAACTTAAATTCATCAAGGCTAATCTCTATATTTGCCTTGTGAGTTTTCTTTTGTGTT
AGTTCTTTTAATAACCACTCATAAATCCTCATAGAGTATTTGTTTTCAAAAGACTTAA
CATGTTCCAGATTATATTTTATGAATTTTTTTAACTGGAAAAGATAAGGCAATATCTC
TTCACTAAAAACTAATTCTAATTTTTCGCTTGAGAACTTGGCATAGTTTGTCCACTGG
AAAATCTCAAAGCCTTTAACCAAAGGATTCCTGATTTCCACAGTTCTCGTCATCAGC
TCTCTGGTTGCTTTAGCTAATACACCATAAGCATTTTCCCTACTGATGTTCATCATCT
GAGCGTATTGGTTATAAGTGAACGATACCGTCCGTTCTTTCCTTGTAGGGTTTTCAAT
CGTGGGGTTGAGTAGTGCCACACAGCATAAAATTAGCTTGGTTTCATGCTCCGTTAA
GTCATAGCGACTAATCGCTAGTTCATTTGCTTTGAAAACAACTAATTCAGACATACA
TCTCAATTGGTCTAGGTGATTTTAAT-3'

FIG. 4
pDS57 plasmid

SEQ ID NO: 23

5'-CACTATACCAATTGAGATGGGCTAGTCAATGATAATTACTAGTCCTTTTCCTTTGA
GTTGTGGGTATCTGTAAATTCTGCTAGACCTTTGCTGGAAAACTTGTAAATTCTGCTA
GACCCTCTGTAAATTCCGCTAGACCTTTGTGTGTTTTTTTTGTTTATATTCAAGTGGTT
ATAATTTATAGAATAAAGAAAGAATAAAAAAAGATAAAAAGAATAGATCCCAGCCC
TGTGTATAACTCACTACTTTAGTCAGTTCCGCAGTATTACAAAAGGATGTCGCAAAC
GCTGTTTGCTCCTCTACAAAACAGACCTTAAAACCCTAAAGGCgtcGGCATCCGCTTA
CAGACAAGCTGTGACCGTCTCCGGGAGCTGCATGTGTCAGAGGTTTTCACCGTCATC
ACCGAAACGCGCGAGGCAGCAGATCAATTCGCGCGCGAAGGCGAAGCGGCATGCA
TTTACGTTGACACCATCGAATGGTGCAAAACCTTTCGCGGTATGGCATGATAGCGCC
CGGAAGAGAGTCAATTCAGGGTGGTGAATGTGAAACCAGTAACGTTATACGATGTC
GCAGAGTATGCCGGTGTCTCTTATCAGACCGTTTCCCGCGTGGTGAACCAGGCCAGC
CACGTTTCTGCGAAAACGCGGGAAAAAGTGGAAGCGGCGATGGCGGAGCTGAATTA
CATTCCCAACCGCGTGGCACAACAACTGGCGGGCAAACAGTCGTTGCTGATTGGCG
TTGCCACCTCCAGTCTGGCCCTGCACGCGCCGTCGCAAATTGTCGCGGCGATTAAAT
CTCGCGCCGATCAACTGGGTGCCAGCGTGGTGGTGTCGATGGTAGAACGAAGCGGC
GTCGAAGCCTGTAAAGCGGCGGTGCACAATCTTCTCGCGCAACGCGTCAGTGGGCT
GATCATTAACTATCCGCTGGATGACCAGGATGCCATTGCTGTGGAAGCTGCCTGCAC
TAATGTTCCGGCGTTATTTCTTGATGTCTCTGACCAGACACCCATCAACAGTATTATT
TTCTCCCATGAAGACGGTACGCGACTGGGCGTGGAGCATCTGGTCGCATTGGGTCAC
CAGCAAATCGCGCTGTTAGCGGGCCCATTAAGTTCTGTCTCGGCGCGTCTGCGTCTG
GCTGGCTGGCATAAATATCTCACTCGCAATCAAATTCAGCCGATAGCGGAACGGGA
AGGCGACTGGAGTGCCATGTCCGGTTTTCAACAAACCATGCAAATGCTGAATGAGG
GCATCGTTCCCACTGCGATGCTGGTTGCCAACGATCAGATGGCGCTGGGCGCAATGC
GCGCCATTACCGAGTCCGGGCTGCGCGTTGGTGCGGATATCTCGGTAGTGGGATACG
ACGATACCGAAGACAGCTCATGTTATATCCCGCCGTtAACCACCATCAAACAGGATT
TTCGCCTGCTGGGGCAAACCAGCGTGGACCGCTTGCTGCAACTCTCTCAGGGCCAGG
CGGTGAAGGGCAATCAGCTGTTGCCCGTCTCACTGGTGAAAAGAAAAACCACCCTG
GCGCCCAATACGCAAACCGCCTCTCCCCGCGCGTTGGCCGATTCATTAATGCAGCTG
GCACGACAGGTTTCCCGACTGGAAAGCGGGCAGTGAGCGCAACGCAATTAATGTaA
GTTAGCGCGAATTGATCTGGTTTGACAGCTTATCATCGACTGCACGGTGCACCAATG
CTTCTGGCGTCAGGCAGCCATCGGAAGCTGTGGTATGGCTGTGCAGGTCGTAAATCA
CTGCATAATTCGTGTCGCTCAAGGCGCACTCCCGTTCTGGATAATGTTTTTGCGCCG
ACATCATAACGGTTCTGGCAAATATTCTGAAATGAGCTGTTGACAATTAATCATCCG
GCTCGTATAATGTGTGGAATTGTGAGCGGATAACAATTTCACACAGGAAACAGCGC
CGCTGAGAAAAAGCGAAGCGGCACTGCTCTTTAACAATTTATCAGACAATCTGTGTG
GGCACTCGACCGGAATTATCGATTAACTTTATTATTAAAAATTAAAGAGGTATATAT
TAATGTATCGATTAAATAAGGAGGAATAAACCATGAAACGTCTCGGAACCCTGGAC
GCCTCCTGGCTGGCGGTTGAATCTGAAGACACCCCGATGCATGTGGGTACGCTTCAG
ATTTTCTCACTGCCGGAAGGCGCACCAGAAACCTTCCTGCGTGACATGGTCACTCGA
ATGAAAGAGGCCGGCGATGTGGCACCACCCTGGGGATACAAACTGGCCTGGTCTGG

FIG. 4 Cont.

TTTCCTCGGGCGCGTGATCGCCCCGGCCTGGAAAGTCGATAAGGATATCGATCTGGA
TTATCACGTCCGGCACTCAGCCCTGCCTCGCCCCGGCGGGGAGCGCGAACTGGGTAT
TCTGGTATCCCGACTGCACTCTAACCCCCTGGATTTTTCCCGCCCTCTTTGGGAATGC
CACGTTATTGAAGGCCTGGAGAATAACCGTTTTGCCCTTTACACCAAAATGCACCAC
TCGATGATTGACGGCATCAGCGGCGTGCGACTGATGCAGAGGGTGCTCACCACCGA
TCCCGAACGCTGCAATATGCCACCGCCCTGGACGGTACGCCCACACCAACGCCGTG
GTGCAAAAACCGACAAAGAGGCCAGCGTGCCCGCAGCGGTTTCCCAGGCAATGGAC
GCCCTGAAGCTCCAGGCAGACATGGCCCCAGGCTGTGGCAGGCCGGCAATCGCCT
GGTGCATTCGGTTCGACACCCGGAAGACGGACTGACCGCGCCCTTCACTGGACCGG
TTTCGGTGCTCAATCACCGGGTTACCGCGCAGCGACGTTTTGCCACCCAGCATTATC
AACTGGACCGGCTGAAAAACCTGGCCCATGCTTCCGGCGGTTCCTTGAACGACATCG
TGCTTTACCTGTGTGGCACCGCATTGCGGCGCTTTCTGGCTGAGCAGAACAATCTGC
CAGACACCCCGCTGACGGCTGGTATACCGGTGAATATCCGGCCGGCAGACGACGAG
GGTACGGGCACCCAGATCAGTTTTATGATTGCCTCGCTGGCCACCGACGAAGCTGAT
CCGTTGAACCGCCTGCAACAGATCAAAACCTCGACCCGACGGGCCAAGGAGCACCT
GCAGAAACTTCCAAAAAGTGCCCTGACCCAGTACACCATGCTGCTGATGTCACCCTA
CATTCTGCAATTGATGTCAGGTCTCGGGGGGAGGATGCGACCAGTCTTAACGTGAC
CATTTCCAACGTGCCCGGCCCGGAAGGCACGCTGTATTATGAAGGAGCCCGGCTTG
AGGCCATGTATCCGGTATCGCTAATCGCTCACGGCGGCGCCCTGAACATCACCTGCC
TGAGCTATGCCGGATCGCTGAATTTCGGTTTTACCGGCTGTCGGGATACGCTGCCGA
GCATGCAGAAACTGGCGGTTTATACCGGTGAAGCTCTGGATGAGCTGGAATCGCTG
ATTCTGCCACCCAAGAAGCGCGCCCGAACCCGCAAGTAACTCGAGATCTGCAGCTG
GTACCATATGGGAATTCGAAGCTTGGGCCCGAACAAAAACTCATCTCAGAAGAGGA
TCTGAATAGCGCCGTCGACCATCATCATCATCATCATTGAGTTTAAACGGTCTCCAG
CTTGGCTGTTTTGGCGGATGAGAGAAGATTTTCAGCCTGATACAGATTAAATCAGAA
CGCAGAAGCGGTCTGATAAAACAGAATTTGCCTGGCGGCAGTAGCGCGGTGGTCCC
ACCTGACCCCATGCCGAACTCAGAAGTGAAACGCCGTAGCGCCGATGGTAGTGTGG
GGTCTCCCCATGCGAGAGTAGGGAACTGCCAGGCATCAAATAAAACGAAAGGCTCA
GTCGAAAGACTGGGCCTTTCGTTTTATCTGTTGTTTGTCGGTGAACGCTCTCCTgacGC
CTGATGCGGTATTTTCTCCTTACGCATCTGTGCGGTATTTCACACCGCATATGGTGCA
CTCTCAGTACAATCTGCTCTGATGCCGCATAGTTAAGCCAGCCCCGACACCCGCCAA
CACCCGCTGACGAGCTTAGTAAAGCCCTCGCTAGATTTTAATGCGGATGTTGCGATT
ACTTCGCCAACTATTGCGATAACAAGAAAAGCCAGCCTTTCATGATATATCTCCCA
ATTTGTGTAGGGCTTATTATGCACGCTTAAAAATAATAAAAGCAGACTTGACCTGAT
AGTTTGGCTGTGAGCAATTATGTGCTTAGTGCATCTAACGCTTGAGTTAAGCCGCGC
CGCGAAGCGGCGTCGGCTTGAACGAATTGTTAGACATTATTTGCCGACTACCTTGGT
GATCTCGCCTTTCACGTAGTGGACAAATTCTTCCAACTGATCTGCGCGCGAGGCCAA
GCGATCTTCTTCTTGTCCAAGATAAGCCTGTCTAGCTTCAAGTATGACGGGCTGATA
CTGGGCCGGCAGGCGCTCCATTGCCCAGTCGGCAGCGACATCCTTCGGCGCGATTTT
GCCGGTTACTGCGCTGTACCAAATGCGGGACAACGTAAGCACTACATTTCGCTCATC
GCCAGCCCAGTCGGGCGGCGAGTTCCATAGCGTTAAGGTTTCATTTAGCGCCTCAAA
TAGATCCTGTTCAGGAACCGGATCAAAGAGTTCCTCCGCCGCTGGACCTACCAAGGC
AACGCTATGTTCTCTTGCTTTTGTCAGCAAGATAGCCAGATCAATGTCGATCGTGGC

FIG. 4 Cont.

```
TGGCTCGAAGATACCTGCAAGAATGTCATTGCGCTGCCATTCTCCAAATTGCAGTTC
GCGCTTAGCTGGATAACGCCACGGAATGATGTCGTCGTGCACAACAATGGTGACTTC
TACAGCGCGGAGAATCTCGCTCTCTCCAGGGGAAGCCGAAGTTTCCAAAAGGTCGTT
GATCAAAGCTCGCCGCGTTGTTTCATCAAGCCTTACGGTCACCGTAACCAGCAAATC
AATATCACTGTGTGGCTTCAGGCCGCCATCCACTGCGGAGCCGTACAAATGTACGGC
CAGCAACGTCGGTTCGAGATGGCGCTCGATGACGCCAACTACCTCTGATAGTTGAGT
CGATACTTCGGCGATCACCGCTTCCCTCATGATGTTTAACTTTGTTTTAGGGCGACTG
CCCTGCTGCGTAACATCGTTGCTGCTCCATAACATCAAACATCGACCCACGGCGTAA
CGCGCTTGCTGCTTGGATGCCCGAGGCATAGACTGTACCCCAAAAAAACAGTCATA
ACAAGCCATGAAAACCGCCACTGCGCCGTTACCACCGCTGCGTTCGGTCAAGGTTCT
GGACCAGTTGCGTGAGCGCATACGCTACTTGCATTACAGCTTACGAACCGAACAGG
CTTATGTCCACTGGGTTCGTGCCTTCATCCGTTTCCACGGTGTGCGTCACCCGGCAAC
CTTGGGCAGCAGCGAAGTCGAGGCATTTCTGTCCTGGCTGGCGAACGAGCGCAAGG
TTTCGGTCTCCACGCATCGTCAGGCATTGGCGGCCTTGCTGTTCTTCTACGGCAAGGT
GCTGTGCACGGATCTGCCCTGGCTTCAGGAGATCGGAAGACCTCGGCCGTCGCGGC
GCTTGCCGGTGGTGCTGACCCCGGATGAAGTGGTTCGCATCCTCGGTTTTCTGGAAG
GCGAGCATCGTTTGTTCGCCCAGCTTCTGTATGGAACGGGCATGCGGATCAGTGAGG
GTTTGCAACTGCGGGTCAAGGATCTGGATTTCGATCACGGCACGATCATCGTGCGGG
AGGGCAAGGGCTCCAAGGATCGGGCCTTGATGTTACCCGAGAGCTTGGCACCCAGC
CTGCGCGAGCAGGGGAATTAATTCCCACGGGTTTTGCTGCCCGCAAACGGGCTGTTC
TGGTGTTGCTAGTTTGTTATCAGAATCGCAGATCCGGCTTCAGCCGGTTTGCCGGCT
GAAAGCGCTATTTCTTCCAGAATTGCCATGATTTTTTCCCCACGGGAGGCGTCACTG
GCTCCCGTGTTGTCGGCAGCTTTGATTCGATAAGCAGCATCGCCTGTTTCAGGCTGTC
TATGTGTGACTGTTGAGCTGTAACAAGTTGTCTCAGGTGTTCAATTTCATGTTCTAGT
TGCTTTGTTTTACTGGTTTCACCTGTTCTATTAGGTGTTACATGCTGTTCATCTGTTAC
ATTGTCGATCTGTTCATGGTGAACAGCTTTGAATGCACCAAAAACTCGTAAAAGCTC
TGATGTATCTATCTTTTTTACACCGTTTTCATCTGTGCATATGGACAGTTTTCCCTTTG
ATATGTAACGGTGAACAGTTGTTCTACTTTTGTTTGTTAGTCTTGATGCTTCACTGAT
AGATACAAGAGCCATAAGAACCTCAGATCCTTCCGTATTTAGCCAGTATGTTCTCTA
GTGTGGTTCGTTGTTTTGCGTGAGCCATGAGAACGAACCATTGAGATCATACTTAC
TTTGCATGTCACTCAAAAATTTTGCCTCAAAACTGGTGAGCTGAATTTTTGCAGTTAA
AGCATCGTGTAGTGTTTTTCTTAGTCCGTTATGTAGGTAGGAATCTGATGTAATGGTT
GTTGGTATTTTGTCACCATTCATTTTTATCTGGTTGTTCTCAAGTTCGGTTACGAGAT
CCATTTGTCTATCTAGTTCAACTTGGAAAATCAACGTATCAGTCGGGCGGCCTCGCT
TATCAACCACCAATTTCATATTGCTGTAAGTGTTTAAATCTTTACTTATTGGTTTCAA
AACCCATTGGTTAAGCCTTTTAAACTCATGGTAGTTATTTTCAAGCATTAACATGAA
CTTAAATTCATCAAGGCTAATCTCTATATTTGCCTTGTGAGTTTTCTTTTGTGTTAGTT
CTTTTAATAACCACTCATAAATCCTCATAGAGTATTTGTTTTCAAAAGACTTAACATG
TTCCAGATTATATTTTATGAATTTTTTAACTGGAAAAGATAAGGCAATATCTCTTCA
CTAAAAACTAATTCTAATTTTTCGCTTGAGAACTTGGCATAGTTTGTCCACTGGAAA
ATCTCAAAGCCTTTAACCAAAGGATTCCTGATTTCCACAGTTCTCGTCATCAGCTCTC
TGGTTGCTTTAGCTAATACACCATAAGCATTTTCCCTACTGATGTTCATCATCTGAGC
GTATTGGTTATAAGTGAACGATACCGTCCGTTCTTTCCTTGTAGGGTTTTCAATCGTG
GGGTTGAGTAGTGCCACACAGCATAAAATTAGCTTGGTTTCATGCTCCGTTAAGTCA
```

FIG. 4 Cont.

TAGCGACTAATCGCTAGTTCATTTGCTTTGAAAACAACTAATTCAGACATACATCTCAATTGGTCTAGGTGATTTTAAT-3'

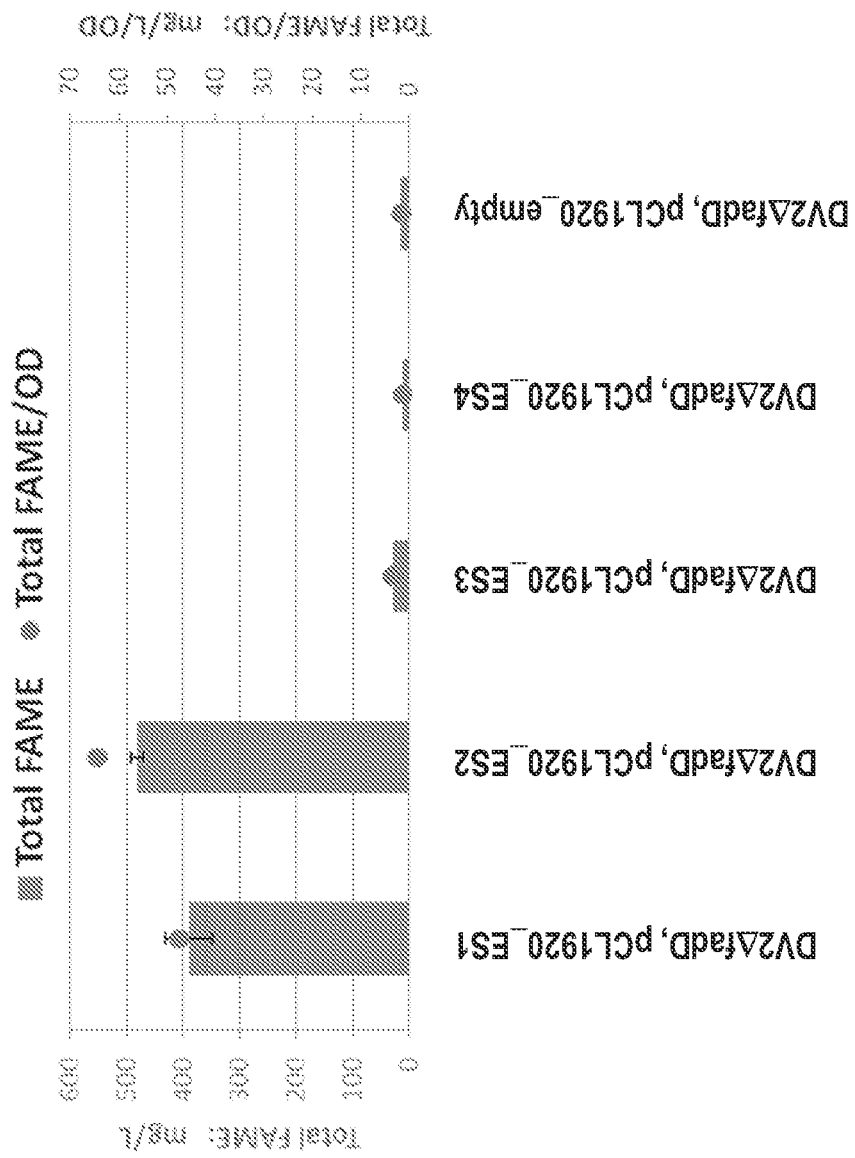

FIG. 16

ES9 Amino Acid Sequence (SEQ ID NO: 18)

```
MKRLGTLDAS WLAVESEDTP MHVGTLQIFS LPEGAPETFL RDMVTRMKEA GDVAPPWGYK
LAWSGFLGRV IAPAWKVDKD IDLDYHVRHS ALPRPGGERE LGILVSRLHS NPLDFSRPLW
ECHVIEGLEN NRFALYTKMH HSMIDGISGV RLMQRVLTTD PERCNMPPPW TVRPHQRRGA
KTDKEASVPA AVSQAMDLAK LQADMAPRLW QAGNRLVHSV RHPEDGLTAP FTGPVSVLNH
RVTAQRRFAT QHYQLDRLKN LAHASGGSLN DIVLYLCGTA LRRFLAEQNN LPDTPLTAGI
PVNIRPADDE GTGTQISFMI ASLATDEADP LNRLQQIKTS TRRAKEHLQK LPKSALTQYT
MLLMSPYILQ LMSGLGGRMR PVFNVTISNV PGPEGTLYYE GARLEAMYPV SLIAHGGALN
ITCLSYAGSL NFGFTGCRDT LPSMQKLAVY TGEALDELES LILPPKKRAR TRK
```

ES9 Nucleotide Sequence (SEQ ID NO:27)

```
   1 atgaaacgtc tcggaaccct ggacgcctcc tggctggcgg ttgaatctga agacacccg
  61 atgcatgtgg gtacgcttca gattttctca ctgccggaag gcgcaccaga aaccttcctg
 121 cgtgacatgg tcactcgaat gaaagaggcc ggcgatgtgg caccaccctg gggatacaaa
 181 ctggcctggt ctggtttcct cgggcgcgtg atcgcccgg cctggaaagt cgataaggat
 241 atcgatctgg attatcacgt ccggcactca gccctgcctc gccccggcgg ggagcgcgaa
 301 ctgggtattc tggtatcccg actgcactct aaccccctgg attttccg ccctctttgg
 361 gaatgccacg ttattgaagg cctggagaat aaccgttttg ccctttacac caaaatgcac
 421 cactcgatga ttgacggcat cagcggcgtg cgactgatgc agaggtgct caccaccgat
 481 cccgaacgct gcaatatgcc accgccctgg acggtacgcc acaccaacg ccgtggtgca
 541 aaaaccgaca agaggccag cgtgcccgca gcggtttccc aggccatgga cgccctgaag
 601 ctccaggcag acatggcccc caggctgtgg caggccggca atcgcctggt gcattcggtt
 661 cgacacccgg aagacggact gaccgcgccc ttcactggac cggtttcggt gctcaatcac
 721 cgggttaccg cgcagcgacg ttttgccacc cagcattatc aactggaccg gctgaaaaac
 781 ctggcccatg cttccggcgg ttccttgaac gacatcgtgc tttacctgtg tggcaccgca
 841 ttgcggcgct tctggctga gcagaacaat ctgccagaca ccccgctgac ggctggtata
 901 ccggtgaata tccggccggc agacgacgag ggtacgggca cccagatcag tttcatgatt
 961 gcctcgctgg ccaccgacga agctgatccg ttgaaccgcc tgcaacagat caaaacctcg
1021 acccgacggg ccaaggagca cctgcagaaa cttccaaaaa gtgccctgac ccagtacacc
1081 atgctgctga tgtcacccta cattctgcaa ttgatgtcag gtctcggggg gaggatgcga
1141 ccagtcttca acgtgaccat ttccaacgtg cccggcccgg aaggcacgct gtattatgaa
1201 ggagcccggc ttgaggccat gtatccggta tcgctaatcg ctcacggcgg cgccctgaac
1261 atcacctgcc tgagctatgc cggatcgctg aatttcggtt ttaccggctg tcgggatacg
1321 ctgccgagca tgcagaaact ggcggtttat accggtgaag ctctggatga gctggaatcg
1381 ctgattctgc cacccaagaa gcgcgcccga acccgcaagt aa
```

AtfA1 Amino Acid Sequence (SEQ ID NO: 25)

```
MKALSPVDQL FLWLEKRQQP MHVGGLQLFS FPEGAGPKYV SELAQQMRDY CHPVAPFNQR
LTRRLGQYYW TRDKQFDIDH HFRHEALPKP GRIRELLSLV SAEHSNLLDR ERPMWEAHLI
EGIRGRQFAL YYKIHHSVMD GISAMRIASK TLSTDPSERE MAPAWAFNTK KRSRSLPSNP
VDMASSMARL TASISKQAAT VPGLAREVYK VTQKAKKDEN YVSIFQAPDT ILNNTITGSR
RFAAQSFPLP RLKVIAKAYN CTINTVVLSM CGHALREYLI SQHALPDEPL IAMVPMSLRQ
DDSTGGNQIG MILANLGTHI CDPANRLRVI HDSVEEAKSR FSQMSPEEIL NFTALTMAPT
GLNLLTGLAP KWRAFNVVIS NIPGPKEPLY WNGAQLQGVY PVSIALDRIA LNITLTSYVD
QMEFGLIACR RTLPSMQRLL DYLEQSIREL
EIGAGIK
```

AtfA1 Nucleotide Sequence (SEQ ID NO:29)

```
   1 atgaaagcgc ttagcccagt ggatcaactg ttcctgtggc tggaaaaacg acagcaaccc
  61 atgcacgtag gcggtttgca gctgttttcc ttcccggaag gtgccggccc caagtatgtg
 121 agtgagctgg cccagcaaat gcgggattac tgccacccag tggcgccatt caaccagcgc
 181 ctgacccgtc gactcggcca gtattactgg actagagaca aacagttcga tatcgaccac
```

FIG. 16 Cont.

```
 241 cacttccgcc acgaagcact ccccaaaccc ggtcgcattc gcgaactgct ttctttggtc
 301 tccgccgaac attccaacct gctggaccgg gagcgcccca tgtgggaagc ccatttgatc
 361 gaagggatcc gcggtcgcca gttcgctctc tattataaga tccaccattc ggtgatggat
 421 ggcatatccg ccatgcgtat cgcctccaaa acgctttcca ctgacccag tgaacgtgaa
 481 atggctccgg cttgggcgtt caacaccaaa aaacgctccc gctcactgcc cagcaacccg
 541 gttgacatgg cctccagcat ggcgcgccta accgcgagca taagcaaaca agctgccaca
 601 gtgcccggtc tcgcgcggga ggtttacaaa gtcacccaaa aagccaaaaa agatgaaaac
 661 tatgtgtcta tttttcaggc tcccgacacg attctgaata ataccatcac cggttcacgc
 721 cgctttgccg cccagagctt tccattaccg cgcctgaaag ttatcgccaa ggcctataac
 781 tgcaccatta acaccgtggt gctctccatg tgtggccacg ctctgcgcga atacttgatt
 841 agccaacacg cgctgcccga tgagccactg attgccatgg tgcccatgag cctgcggcag
 901 gacgacagca ctggcggcaa ccagatcggt atgatcttgg ctaacctggg cacccacatc
 961 tgtgatccag ctaatcgcct gcgcgtcatc cacgattccg tcgaggaagc caaatcccgc
1021 ttctcgcaga tgagcccgga agaaattctc aatttcaccg ccctcaccat ggctcccacc
1081 ggcttgaact tactgaccgg cctagcgcca aaatggcggg ccttcaacgt ggtgatttcc
1141 aacatacccg gccgaaaga gccgctgtac tggaatggtg cacagctgca aggagtgtat
1201 ccagtatcca ttgccttgga tcgcatcgcc ctaaatatca ccctcaccag ttatgtagac
1261 cagatggaat ttgggcttat cgcctgccgc cgtactctgc cttccatgca gcgactactg
1321 gattacctgg aacagtccat ccgcgaattg gaaatcggtg caggaattaa atag
```

AtfA2 Amino Acid Sequence (SEQ ID NO: 26)

```
MARKLSIMDS GWLMMETRET PMHVGGLALF AIPEGAPEDY VESIYRYLVD VDSICRPFNQ
KIQSHLPLYL DATWVEDKNF DIDYHVRHSA LPRPGRVREL LALVSRLHAQ RLDPSRPLWE
SYLIEGLEGN RFALYTKMHH SMVDGVAGMH LMQSRLATCA EDRLPAPWSG EWDAEKKPRK
SRGAAAANAG MKGTMNNLRR GGGQLVDLLR QPKDGNVKTI YRAPKTQLNR RVTGARRFAA
QSWSLSRIKA AGKQHGGTVN DIFLAMCGGA LRRYLLSQDA LSDQPLVAQV PVALRSADQA
GEGGNAITTV QVSLGTHIAQ PLNRLAAIQD SMKAVKSRLG DMQKSEIDVY TVLTNMPLSL
GQVTGLSGRV SPMFNLVISN VPGPKETLHL NGAEMLATYP VSLVLHGYAL NITVVSYKNS
LEFGVIGCRD TLPHIQRFLV YLEESLVELE
P
```

AtfA2 Nucleotide Sequence (SEQ ID NO:30)

```
   1 atggcccgta aattgtctat tatggattcc ggctggttaa tgatggagac ccgggaaacc
  61 cctatgcatg tggggggggtt ggcgttgttt gccattccag aaggtgctcc tgaggattat
 121 gtggaaagta tctatcgata cctggtggat gtggatagca tctgccgccc atttaaccaa
 181 aagattcagt ctcatttgcc cctgtactta gatgctactt gggtggaaga caaaaatttc
 241 gatattgact accacgtacg gcattctgcc ttgcctcggc cgggacgggt gcgtgagctg
 301 ttggcgttag tatcgcggtt gcacgcccag cgtttggatc ctagccgccc gttgtgggag
 361 agctatttga tcgaggggtt ggagggaaac cgtttcgctc tttataccaa gatgcatcac
 421 tccatggtgg atggggtggc agggatgcac ctaatgcagt ctcgcctagc tacttgtgcg
 481 gaagaccgtt taccccgccc ttggtctggc gagtgggatg cagagaagaa accgagaaag
 541 agccgtggcg ctgcagcggc gaatgccggt atgaaggaa caatgaataa cctgcgccga
 601 ggtggtggtc agcttgtgga cctgctgcga cagcccaagg atggcaacgt aaagactatc
 661 tatcgggcgc cgaaaaccca gctaaaccgc cgggtgacgg gcgcgcgacg ctttgctgcc
 721 cagtcgtggt cgctgtcgcg gattaaagcc gcgggcaaac agcatggcgg tacggtgaat
 781 gatatttttcc ttgccatgtg tggcggcgcg ctgcgtcgct atctgctcag tcaggatgcc
 841 ttgtccgatc agccgttggt agcccaggtg ccagtagcct tgcgtagtgc ggatcaggct
 901 ggtgagggtg gcaatgccat tactacggtt caggtaagcc tgggtacgca tattgctcag
 961 ccgctgaatc ggctggccgc aatccaggat tccatgaaag cggtgaaatc tcggcttggt
1021 gatatgcaga agtccgagat cgatgtttat acggtgctga ccaatatgcc gctgtctttg
1081 ggcaggtca cgggcctgtc cgggcgcgta agcccatgt ttaacctagt gatttccaat
1141 gtgccggggc cgaaggaaac gcttcatctc aatggtgcgg agatgttggc tacctatccg
```

FIG. 16 Cont.

```
1201 gtgtcattgg ttctgcatgg ttacgcccta aatatcactg tggtgagcta caagaatagc
1261 cttgagtttg gcgtgatcgg ttgccgtgac acgttgcctc atattcagcg ttttctggtt
1321 tatctcgaag aatcgctggt ggagctggag ccttga
```

ES8 Amino Acid Sequence (SEQ ID NO:24)

```
MTPLNPTDQL FLWLEKRQQP MHVGGLQLFS FPEGAPDDYV AQLADQLRQK TEVTAPFNQR
LSYRLGQPVW VEDEHLDLEH HFRFEALPTP GRIRELLSFV SAEHSHLMDR ERPMWEVHLI
EGLKDRQFAL YTKVHHSLVD GVSAMRMATR MLSENPDEHG MPPIWDLPCL SRDRGESDGH
SLWRSVTHLL GLSDRQLGTI PTVAKELLKT INQARKDPAY DSIFHAPRCM LNQKITGSRR
FAAQSWCLKR IRAVCEAYGT TVNDVVTAMC AAALRTYLMN QDALPEKPLV AFVPVSLRRD
DSSGGNQVGV ILASLHTDVQ DAGERLLKIH HGMEEAKQRY RHMSPEEIVN YTALTLAPAA
FHLLTGLAPK WQTFNVVISN VPGPSRPLYW NGAKLEGMYP VSIDMDRLAL NMTLTSYNDQ
VEFGLIGCRR TLPSLQRMLD YLEQGLAELE
LNAGL
```

ES8 Nucleotide Sequence (SEQ ID NO:28)

```
   1 atgacgcccc tgaatcccac tgaccagctc tttctctggc tggaaaaacg ccagcagccc
  61 atgcatgtgg gcggcctcca gctgttttcc ttccccgaag cgcgccgga cgactatgtc
 121 gcgcagctgg cagaccagct tcggcagaag acggaggtga ccgccccctt taaccagcgc
 181 ctgagctatc gcctgggcca gccggtatgg gtggaggatg agcacctgga ccttgagcat
 241 catttccgct tcgaggcgct gcccacaccc gggcgtattc gggagctgct gtcgttcgta
 301 tcggcggagc attcgcacct gatggaccgg gagcgcccca tgtgggaggt gcacctgatc
 361 gagggcctga agaccggca gtttgcgctc tacaccaagg ttcaccattc cctggtggac
 421 ggtgtctcgg ccatgcgcat ggccacccgg atgctgagtg aaacccggga cgaacacggc
 481 atgccgccaa tctgggatct gccttgcctg tcacgggata ggggtgagtc ggacggacac
 541 tccctctggc gcagtgtcac ccatttgctg gggctttcgg accgccagct cggcaccatt
 601 cccactgtgg caaaggagct actgaaaacc atcaatcagg cccgaagga tccggcctac
 661 gactccattt ccatgccccc gcgctgcatg ctgaaccaga aaatcaccgg ttcccgtcga
 721 ttcgccgctc agtcctggtg cctgaaacgg attcgcgccg tatgcgaggc ctacggcacc
 781 acggtcaacg atgtcgtgac tgccatgtgc gcagcggctc tgcgtaccta tctgatgaat
 841 caggatgcct tgccggagaa accactggtg gcctttgtgc cggtgtcgct acgccgggac
 901 gacagctccg gcggcaacca ggtaggcgtc atcctggcga gccttcacac cgatgtgcag
 961 gacgccggcg aacgactgtt aaaaattcac cacggcatgg aagaggccaa gcagcgctac
1021 cggcatatga gcccggagga aatcgtcaac tacacggccc tgaccctggc gccggccgcc
1081 ttccacctgc tgaccgggct ggcgcccaag tggcagacct tcaatgtggt gatttccaat
1141 gtccccgggc catccaggcc cctgtactgg aacggggcga aactggaagg catgtatccg
1201 gtgtctatcg atatggacag gctggccctg aacatgacac tgaccagcta taacgaccag
1261 gtggagttcg gcctgattgg ctgtcgccgg accctgccca gcctgcaacg gatgctggac
1321 tacctggaac agggtctggc agagctggag ctcaacgccg gtctgtaa
```

ES1 (*Marinobacter algicola* DG893, ZP_01893763) Amino Acid Sequence (SEQ ID NO:39)

```
MKRLGTLDASWLAVESEDTPMHVGNLQIFSLPEDAPETFLRDMLARMKADADVAPPWCYKLAFSGFLGRL
VAPSWKVDKKLDLDYHVRHSALPRPGSERELGILVSRLHSNPLDFSRPLWECHIIEGL
ENNRFALYTKMHHSMIDGISGVRLMQRVLSEDPGEINMLPPWSVRPERTRGSKTDSEASISAALSQAMEA
LRIQADMAPRLWNAMNRLIQSARHPEEGLTAPFAGPVSALNHRVTGQRRFATQHYQLERIKQVAQASNGS
LNDIVLYLCGTALRRFLVEQDGLPDTPLTAGIPVNIRPSDDQGTGTQISFMI
ASLATDEADPLKRLKSIKHSTRRAKQHLQKLPRKALTQYTMLLMSPYILQLMSGLGGRMRPVFNVTISNV
PGPGETLYYEGARLEAMYPVSLIAHGGALNITCLSYAGSLNFGFTGCRDTLPSMQKLAVYTGEALDELES
LVSPPPNQTKTNARKAPRKKTAEKS
```

ES2 (*Limnobacter sp.* MED105, ZP_01915979) Amino Acid Sequence (SEQ ID NO:41)

```
MARNIPLLDASWLYVESKEAPMHVGSMAIFTVPEGETSQQAIARIVQMLRNSLEFAPPFNYRLSSPRLLT
LMPKWIEADKIDLDYHFRHSALPAPGGERELGTLISRLHSHPLDFRKPLWEMHLIEGLYGNRFALYTKMH
```

FIG. 16 Cont.

HSLMDGVGGMRLMERIFGKSAKESMNLPAPWSVGTISRKKKNSEPQHFADQAREAWEAAKLSGQSLPAAG
RALMDLMREAVKPTDPALATPFSGPKSIVNKRVGGARRLATQTYPLERVRAVAEAAKVSVNDIFLAICSS
SIRRYLLERDALPSESLTAGLPVSVRPADDLDGGNAISFIIANLYTTEADPLTRLKEIRRSTQLAKANLQ
AMPKEAINNYTIMLMAPMMLQLVSGLGGLTRPIFNTVISNVPGPSRDLYFSGCRLEQFYPISLIPHGQAL
NITVVSYSGQFNVAFTGDHDALPSMQRLSVYTGEALEELEAALGVKWASKPVVKPVTEKRPVAAKKPAVR
KPATAKVGAGKPVKAPED

ES3 (Marine metagenome EDJ50241) Amino Acid Sequence (SEQ ID NO:43)

MARTPLNVQDATFLSVETADYPTHIAGLQIFEMPEADPDFVGRLVERLVQAPVAPFWRRVLAPGFLGSTL
SADWIEAEEIDLDFHVRRMALPRPGSLEQLEHLVERLHARPLDRSRPLWECYFVEGLGPNRFAIYAKVHH
ALVDGMGGIWLALAALAQDPEAEPTAPWSVDLPSRPRAPAPSLLDRLTGGARLVNDLSMQNLRQSLDWAG
RLAGAHARADLPFAAPHTPFNGRVDGYRRFVTKSLPLTRVKAVAKATGTTINDVVLALTGAALRTWLDGQ
GALPERSLVASVPVSVRAADGAGNNLSALLADLGTDVETPLERLQRVRESTARGKDMIARLSRGAAEAWA
LVMGLAGLAPALVNGGRTLPPLANLVISNVPGPRGKRYYAGAELIGYYPVSILTHGQGLNVTLVSRGESI
DFGLTGAQSLIRDLDKLGDALEAALADYEAAVGDDLAQRNAAFTAAVPAPVVDVEAGDGAARPGVTRVA

ES4 (Whalefall sample #3, 2001496676* (IMG identification)) Amino Acid Sequence (SEQ ID NO:45)

MRLLTAVDQLFLLLESRKQPMHVGGLFVFELPDNADSDFVYQLVKQMQESDVPPSFPFNQVLEHLAFWKK
DKDFDVEHHLHHVALPSPGRVRELLMYVSREHGRLLDRAMPLWECHVVEGIEPETEGSPERFALYFKIHH
SLVDGIAAMRLVQKSLSQSATEPVTLPVWSLMARHRNHVNAILPAERSVKRIIKEQISTIKPVFTELLDN
LKNYSDEGYVGTFDAPMSILNKRISASRRIAAQSYDIKRFNDIAERLNISKNDVVLAVCSGALRRYLISM
DALPSKPLIAFVPMSLRTDKSVSGNQLSFVLANLGTHLDNPLRRIELIHRSMNNGKRRFRRMNQAQVINY
SVIAYAWEGINLATGLFPKKQAFNLIISNVPGSEKPLYWNGARLQSLYPASIVFNGQAMNITLASYLDKI
EFGITACSKALPRVQDMLMLIEEELQLLETTSKELAFKGITVEDKAGNKGDDKTKKLTP

Codon Optimized Polynucleotide Sequences Encoding ES1 (*Marinobacter algicola* DG893) (SEQ ID NO:40)

atgaaacgtctgggcactctggatgcttcttggttggccgtggaaagcgaggacacgccgatgcacgttggcaacct
gcagattttcagcctgccggaggacgcaccggaaacgttcctgcgcgacatgctggcccgcatgaaagcagacgcgg
acgtggcaccgccttggtgttacaaactggcgtttagcggttttctgggccgtctggtggcgccaagctggaaagtg
gataagaagctggatctggactatcatgttcgccatagcgcattgccgcgtccgggcagcgaacgtgagctgggtat
tctggtgagccgcctgcatagcaatccgctggacttttcccgtccgctgtgggaatgccacattatcgagggcttgg
aaaacaaccgtttcgcactgtataccaaaatgcaccacagcatgattgacggtatcagcggtgtccgtctgatgcag
cgtgtgctgagcgaagatccgggtgagatcaatatgctgccgcgtggagcgttcgcccggagcgtacccgtggttc
caaaaccgatagcgaagcgagcatctctgcagcactgtcccaagcaatggaggcgctgcgcattcaagcagatatgg
ctccgcgcctgtggaatgcgatgaatcgtctgattcaaagcgcgcgtcatccagaagaaggtttgactgcgccgttc
gccggtccggtttctgccctgaaccaccgcgttacgggtcagcgccgttttgcaacccaacactatcagct
ggagcgcatcaagcaggtggcgcaggcgagcaatggctccctgaatgacatcgtcttgtatctgtgcggc
accgcattgcgtcgctttctggttgaacaagacggtttgccggataccccactgaccgcaggcatccgg
tgaacattcgtccgagcgacgaccaaggtacgggcacgcaaatcagctttatgattgcctccctggcgac
cgatgaggcggatcctctgaagcgtctgaagtcgatcaagcacagcacccgtcgtgccaaacagcatctg
cagaagctgccgcgtaaggcgctgacgcaatacacgatgctgttgatgagcccgtacatcctgcaactga
tgagcggtttgggcggtcgcatgcgtccggtctttaacgttacgatctccaacgtccctggtccaggcga
aaccctgtactatgaaggtgcgcgcctggaggcgatgtatccggtcagcctgattgcgcacggtggcgcg
ttgaacattacctgtctgagctacgctggtagcctgaatttcggtttcactggctgccgcgatacgctgc
cgtcgatgcagaaattggccgtctacaccggtgaggccctggatgagctggagagcctggtttctccacc
gcctaaccagaccaagaccaatgcgcgtaaagctccgcgtaagaaaacggctgagaaaagctaa

FIG. 16 Cont.

Codon Optimized Polynucleotide Sequence encoding ES2 (Limnobacter sp. MED105) (SEQ ID NO:42)

```
atggcccgcaatatccctctgttggatgcgagctggctgtatgtcgaaagcaaagaggcaccgatgcacg
tcggtagcatggcgatcttcacggtgccagagggcgaaacgagccaacaggcaattgcgcgcattgtgca
gatgctgcgtaactctctggagtttgcaccgccgtttaactaccgtctgtccagcccacgcctgctgacc
ctgatgccgaaatggatcgaagccgataagattgacttggactaccactttcgccatagcgcgctgccgg
ctccggggtggcgaacgtgagctgggtaccctgattagccgtttgcacagccaccgttggactttcgtaa
acctctgtgggagatgcacctgattgagggtctgtatggcaatcgttttgcgttgtacacgaagatgcat
cacagcttgatggacggtgttggtggcatgcgtctgatggagcgtatcttcggcaaatctgccaaagaaa
gcatgaatctgccagcaccttggagcgttggcaccatcagccgcaagaagaaaaactccgaaccgcaaca
tttcgcagatcaagcgcgtgaggcgtgggaagccgcgaaactgtcgggccagtccctgccagcggctggc
cgtgcgctgatggatttgatgcgcgaagccgtgaagccgacggatccggccctggcaacgccgttcagcg
gtccgaaatccatcgtcaacaagcgtgttggcggtgcgcgtcgcctggcgacccagacctaccgctgga
acgtgtgcgtgctgttgcggaggccgcgaaggtgagcgttaacgacattttcctggctatttgcagctct
tctattcgtcgttacctgctggaacgcgatgccttgccgagcgagtctctgaccgctggtctgcctgtga
gcgtccgtcctgctgatgatctggacggtggcaatgcgattagctttatcattgccaatctgtatacgac
cgaggcggacccgctgacccgcctgaaagaaatccgccgtagcactcaactggcgaaggcgaacctgcaa
gcaatgccgaaagaggcaatcaacaattacacgatcatgctgatggccccgatgatgctgcaactggtca
gcggcctgggtggtctgacccgtccgatcttcaacaccgttatctccaacgtgccgggtccgagccgtga
cttgtatttctcgggttgtcgtctggaacagttctatccgattagcctgattccgcacggtcaggcgctg
aatatcaccgttgtcagctatagcggtcagtttaacgtcgcgttcaccggcgaccacgatgcactgccga
gcatgcagcgtctgtccgtgtacaccggtgaggccctggaagaactggaggcggctctgggcgtgaagtg
ggcaagcaagccggttgttaaaccggtgaccgagaaacgcccggtcgcggcgaagaagccggcagttcgt
aagccggcgactgcaaaagttggtgccggtaagccggtcaaagctccggaggattaa
```

Codon Optimized Polynucleotide Sequence Encoding ES3 (Marine metagenome) (SEQ ID NO:44)

```
atggcacgtacgccgctgaatgttcaggatgcaaccttctgtctgttgaaaccgcggattacccgacgc
atattgcgggtttgcagatcttcgaaatgccggaggccgatccggattttgttggtcgcctggtcgaacg
cctggtccaggctccggtcgcgcctttctggcgtcgtgtgctggcccctggcttcctgggtagcaccctg
agcgcagactggattgaagcggaagagatcgacctggatttccacgtccgtcgtatggcgctgccgcgtc
cgggcagcctggagcaactggaacacctggttgagcgtctgcacgcacgtccgctggaccgtagccgccc
actgtgggaatgctatttcgtcgaaggtctgggtccgaaccgctttgccatctacgccaaagtccaccac
gcgctggtcgatggtatgggcggcatctggttggccctggccgcattggcacaagatccggaggcggagc
cgactgccccgtggtccgtggatctgccgagccgtccgcgtgctccggcaccatccctgctggaccgcct
gaccggcggtgcgcgtctggtgaatgacctgagcatgcaaaacctgcgccagagcctggattgggcaggt
cgtctggcaggcgcccatgcacgcgcggacctgccattcgctgcgccgcatacgccgttcaatggccgcg
tcgacggctaccgtcgttttgttaccaagtcgttgcctctgacccgtgttaaggccgttgccaaggcgac
gggtaccaccatcaacgacgttgttctggcgctgacgggtgcggcgttgcgcacctggctggatggccaa
ggcgcgctgccggagcgcagcttggtggcgagcgttccggtgtctgttcgtgccgcggatggcgctggca
acaacctgagcgcgctgctggccgacctgggcacggatgtcgagactccgttggagcgcctgcagcgtgt
tcgtgagagcaccgcacgtggtaaggacatgattgcacgtctgtcccgtggtgcggcggaggcttggcg
ctggtcatgggtctggcgggtctggctccggcgctggtgaacggtggccgtaccctgccgccactggcca
atctggtcattagcaacgtgccgggtccgcgtggtaaacgctattacgcaggtgcggaactgatcggtta
ctacccggttagcattctgacgcacggccaaggcctgaatgtgaccttggttagccgcgtgagagcatc
gactttggtttgaccggtgcgcagtcgttgattcgcgatctggacaaactgggcgacgcgctggaggctg
cactggcagactatgaggcagctgtgggtgatgacttggcacagcgcaatgcggcttttaccgcagctgt
gccagcaccggtggtcgacgtggaagcgggtgatggtgcggcacgccctggcgtgacgcgtgtggcctaa
```

FIG. 16 Cont.

Codon Optimized Polynucleotide Sequence Encoding E4 (Whalefall sample #3) (SEQ ID NO:46)

atgagactgttgacggctgttgaccaactgtttctgttgctggagagccgtaagcaaccgatgcatgtcg
gcggtctgtttgttttcgagctgccggacaacgcggacagcgattttgtgtaccaactggttaagcaaat
gcaagaaagcgacgtgccgccttcgtttccgttcaatcaggtcctggagcatctggcttttttggaagaaa
gataaagatttgatgttgaacaccacttgcaccacgtggccctgccgtccccgggtcgtgtccgtgagc
tgctgatgtacgttagccgtgagcacggtcgtctgctggaccgcgcaatgccattgtgggaatgccatgt
tgttgagggtatcgaaccggaaaccgaaggtagcccggagcgttttgcactgtatttcaaaatccatcac
agcctggttgatggtattgcagctatgcgtttggtgcagaaaagcctgagccaaagcgcgaccgaaccgg
tcacgctgccggtgtggagcctgatggcacgtcatcgtaaccacgtcaacgcgattctgccggctgaacg
cagcgtgaagcgtatcatcaaagagcagatcagcaccatcaaaccggtgttcacggaactgctggataat
ctgaaaaactactccgacgagggctatgtcggtaccttcgatgcacctatgagcatcctgaacaagcgca
tttctgcctcccgccgtattgcggcacagagctacgacatcaagcgtttcaacgacattgcggagcgtct
gaacattagcaagaacgatgtggtcctggcggtttgcagcggtgccctgcgccgttatctgattagcatg
gacgcgctgccgagcaaaccgttgatcgcgtttgtccctatgagcttgcgcacggacaaatccgttagcg
gcaatcagctgagcttcgtcctggcgaatctgggcactcacctggataaccgctgcgtcgtattgagtt
gattcatcgttctatgaacaatggtaagcgtcgcttccgccgtatgaaccaagcacaggtgatcaattac
agcgtcatcgcgtatgcatgggagggtatcaatctggccaccggcctgtttccaaagaagcaagccttca
atctgatcatctctaacgtgccgggttcggagaaaccgctgtactggaatggtgcccgcttgcagtccct
gtatccggcgagcattgtgtttaacggtcaggcgatgaatatcacgctggcgtcttatctggacaagatt
gagttcggcatcaccgcctgttctaaggcgctgccgcgtgttcaagatatgctgatgctgattgaagaag
agctgcagttgctggaaacgactagcaaagaactggcattcaaaggcattaccgttgaggacaaggcggg
taacaagggcgacgacaaaaccaagaaactgaccccataa

FIG. 17

>gi|40796035|gb|AAR91681.1| ATP/NADPH-dependent carboxylic acid reductase [Nocardia sp. NRRL 5646] (SEQ ID NO:54)

MAVDSPDERLQRRIAQLFAEDEQVKAARPLEAVSAAVSAPGMRLAQIAATVMAGYADRPAAGQRAFELNT
DDATGRTSLRLLPRFETITYRELWQRVGEVAAAWHHDPENPLRAGDFVALLGFTSIDYATLDLADIHLGA
VTVPLQASAAVSQLIAILTETSPRLLASTPEHLDAAVECLLAGTTPERLVVFDYHPEDDDQRAAFESARR
RLADAGSLVIVETLDAVRARGRDLPAAPLFVPDTDDDPLALLIYTSGSTGTPKGAMYTNRLAATMWQGNS
MLQGNSQRVGINLNYMPMSHIAGRISLFGVLARGGTAYFAAKSDMSTLFEDIGLVRPTEIFFVPRVCDMV
FQRYQSELDRRSVAGADLDTLDREVKADLRQNYLGGRFLVAVVGSAPLAAEMKTFMESVLDLPLHDGYGS
TEAGASVLLDNQIQRPPVLDYKLVDVPELGYFRTDRPHPRGELLLKAETTIPGYYKRPEVTAEIFDEDGF
YKTGDIVAELEHDRLVYVDRRNNVLKLSQGEFVTVAHLEAVFASSPLIRQIFIYGSSERSYLLAVIVPTD
DALRGRDTATLKSALAESIQRIAKDANLQPYEIPRDFLIETEPFTIANGLLSGIAKLLRPNLKERYGAQL
EQMYTDLATGQADELLALRREAADLPVLETVSRAAKAMLGVASADMRPDAHFTDLGGDSLSALSFSNLLH
EIFGVEVPVGVVVSPANELRDLANYIEAERNSGAKRPTFTSVHGGGSEIRAADLTLDKFIDARTLAAADS
IPHAPVPAQTVLLTGANGYLGRFLCLEWLERLDKTGGTLICVVRGSDAAAARKRLDSAFDSGDPGLLEHY
QQLAARTLEVLAGDIGDPNLGLDDATWQRLAETVDLIVHPAALVNHVLPYTQLFGPNVVGTAEIVRLAIT
ARRKPVTYLSTVGVADQVDPAEYQEDSDVREMSAVRVVRESYANGYGNSKWAGEVLLREAHDLCGLPVAV
FRSDMILAHSRYAGQLNVQDVFTRLILSLVATGIAPYSFYRTDADGNRQRAHYDGLPADFTAAAITALGI
QATEGFRTYDVLNPYDDGISLDEFVDWLVESGHPIQRITDYSDWFHRFETAIRALPEKQRQASVLPLLDA
YRNPCPAVRGAILPAKEFQAAVQTAKIGPEQDIPHLSAPLIDKYVSDLELLQLL

>gi|15609727|ref|NP_217106.1| fatty-acid-CoA ligase [Mycobacterium tuberculosis H37Rv] (SEQ ID NO:55)

MSINDQRLTRRVEDLYASDAQFAAASPNEAITQAIDQPGVALPQLIRMVMEGYADRPALGQRALRFVTDP
DSGRTMVELLPRFETITYRELWARAGTLATALSAEPAIRPGDRVCVLGFNSVDYTTIDIALIRLGAVSVP
LQTSAPVTGLRPIVTETEPTMIATSIDNLGDAVEVLAGHAPARLVVFDYHGKVDTHREAVEAARARLAGS
VTIDTLAELIERGRALPATPIADSADDALALLIYTSGSTGAPKGAMYRESQVMSFWRKSSGWFEPSGYPS
ITLNFMPMSHVGGRQVLYGTLSNGGTAYFVAKSDLSTLFEDLALVRPTELCFVPRIWDMVFAEFHSEVDR
RLVDGADRAALEAQVKAELRENVLGGRFVMALTGSAPISAEMTAWVESLLADVHLVEGYGSTEAGMVLND
GMVRRPAVIDYKLVDVPELGYFGTDQPYPRGELLVKTQTMFPGYYQRPDVTAEVFDPDGFYRTGDIMAKV
GPDQFVYLDRRNNVLKLSQGEFIAVSKLEAVFGDSPLVRQIFIYGNSARAYPLAVVVPSGDALSRHGIEN
LKPVISESLQEVARAAGLQSYEIPRDFIIETTPFTLENGLLTGIRKLARPQLKKFYGERLERLYTELADS
QSNELRELRQSGPDAPVLPTLCRAAAALLGSTAADVRPDAHFADLGGDSLSALSLANLLHEIFGVDVPVG
VIVSPASDLRALADHIEAARTGVRRPSFASIHGRSATEVHASDLTLDKFIDAATLAAAPNLPAPSAQVRT
VLLTGATGFLGRYLALEWLDRMDLVNGKLICLVRARSDEEAQARLDATFDSGDPYLVRHYRELGAGRLEV
LAGDKGEADLGLDRVTWQRLADTVDLIVDPAALVNHVLPYSQLFGPNAAGTAELLRLALTGKRKPYIYTS
TIAVGEQIPPEAFTEDADIRAISPTRRIDDSYANGYANSKWAGEVLLREAHEQCGLPVTVFRCDMILADT
SYTGQLNLPDMFTRLMLSLAATGIAPGSFYELDAHGNRQRAHYDGLPVEFVAEAICTLGTHSPDRFVTYH
VMNPYDDGIGLDEFVDWLNSPTSGSGCTIQRIADYGEWLQRFETSLRALPDRQRHASLLPLLHNYREPAK
PICGSIAPTDQFRAAVQEAKIGPDKDIPHLTAAIIAKYISNLRLLGLL

>gi|118174788|gb|ABK75684.1| NAD dependent epimerase/dehydratase family protein [Mycobacterium smegmatis str. MC2 155] (SEQ ID NO:56)

MTIETREDRFNRRIDHLFETDPQFAAARPDEAISAAAADPELRLPAAVKQILAGYADRPALGKRAVEFVT
DEEGRTTAKLLPRFDTITYRQLAGRIQAVTNAWHNHPVNAGDRVAILGFTSVDYTTIDIALLELGAVSVP
LQTSAPVAQLQPIVAETEPKVIASSVDFLADAVALVESGPAPSRLVVFDYSHEVDDQREAFEAAKGKLAG
TGVVVETITDALDRGRSLADAPLYVPDEADPLTLLIYTSGSTGTPKGAMYPESKTATMWQAGSKARWDET
LGVMPSITLNFMPMSHVMGRGILCSTLASGGTAYFAARSDLSTFLEDLALVRPTQLNFVPRIWDMLFQEY
QSRLDNRRAEGSEDRAEAAVLEEVRTQLLGGRFVSALTGSAPISAEMKSWVEDLLDMHLLEGYGSTEAGA
VFIDGQIQRPPVIDYKLVDVPDLGYFATDRPYPRGELLVKSEQMFPGYYKRPEITAEMFDEDGYYRTGDI
VAELGPDHLEYLDRRNNVLKLSQGEFVTVSKLEAVFGDSPLVRQIYVYGNSARSYLLAVVVPTEEALSRW
DGDELKSRISDSLQDAARAAGLQSYEIPRDFLVETTPFTLENGLLTGIRKLARPKLKAHYGERLEQLYTD
LAEGQANELRELRRNGADRPVVETVSRAAVALLGASVTDLRSDAHFTDLGGDSLSALSFSNLLHEIFDVD
VPVGVIVSPATDLAGVAAYIEGELRGSKRPTYASVHGRDATEVRARDLALGKFIDAKTLSAAPGLPRSGT
EIRTVLLTGATGFLGRYLALEWLERMDLVDGKVICLVRARSDDEARARLDATFDTGDATLLEHYRALAAD
HLEVIAGDKGEADLGLDHDTWQRLADTVDLIVDPAALVNHVLPYSQMFGPNALGTAELIRIALTTTIKPY
VYVSTIGVGQGISPEAFVEDADIREISATRRVDDSYANGYGNSKWAGEVLLREAHDWCGLPVSVFRCDMI
LADTTYSGQLNLPDMFTRLMLSLVATGIAPGSFYELDADGNRQRAHYDGLPVEFIAEAISTIGSQVTDGF

FIG. 17 Cont.

ETFHVMNPYDDGIGLDEYVDWLIEAGYPVHRVDDYATWLSRFETALRALPERQRQASLLPLLHNYQQPSP
PVCGAMAPTDRFRAAVQDAKIGPDKDIPHVTADVIVKYISNLQMLGLL

>gi|118469671|ref|YP_889972.1| putative long-chain fatty-acid--CoA ligase
[Mycobacterium smegmatis str. MC2 155](SEQ ID NO:57)

MTSDVHDATDGVTETALDDEQSTRRIAELYATDPEFAAAAPLPAVVDAAHKPGLRLAEILQTLFTGYGDR
PALGYRARELATDEGGRTVTRLLPRFDTLTYAQVWSRVQAVAAALRHNFAQPIYPGDAVATIGFASPDYL
TLDLVCAYLGLVSVPLQHNAPVSRLAPILAEVEPRILTVSAEYLDLAVESVRDVNSVSQLVVFDHHPEVD
DHRDALARAREQLAGKGIAVTTLDAIADEGAGLPAEPIYTADHDQRLAMILYTSGSTGAPKGAMYTEAMV
ARLWTMSFITGDPTPVINVNFMPLNHLGGRIPISTAVQNGGTSYFVPESDMSTLFEDLALVRPTELGLVP
RVADMLYQHHLATVDRLVTQGADELTAEKQAGAELREQVLGGRVITGFVSTAPLAAEMRAFLDITLGAHI
VDGYGLTETGAVTRDGVIVRPPVIDYKLIDVPELGYFSTDKPYPRGELLVRSQTLTPGYYKRPEVTASVF
DRDGYYHTGDVMAETAPDHLVYVDRRNNVLKLAQGEFVAVANLEAVFSGAALVRQIFVYGNSERSFLLAV
VVPTPEALEQYDPAALKAALADSLQRTARDAELQSYEVPADFIVETEPFSAANGLLSGVGKLLRPNLKDR
YGQRLEQMYADIAATQANQLRELRRAAATQPVIDTLTQAAATILGTGSEVASDAHFTDLGGDSLSALTLS
NLLSDFFGFEVPVGTIVNPATNLAQLAQHIEAQRTAGDRRPSFTTVHGADATEIRASELTLDKFIDAETL
RAAPGLPKVTTEPRTVLLSGANGWLGRFLTLQWLERLAPVGGTLITIVRGRDDAAARARLTQAYDTDPEL
SRRFAELADRHLRVVAGDIGDPNLGLTPEIWHRLAAEVDLVVHPAALVNHVLPYRQLFGPNVVGTAEVIK
LALTERIKPVTYLSTVSVAMGIPDFEEDGDIRTVSPVRPLDGGYANGYGNSKWAGEVLLREAHDLCGLPV
ATFRSDMILAHPRYRGQVNVPDMFTRLLLSLLITGVAPRSFYIGDGERPRAHYPGLTVDFVAEAVTTLGA
QQREGYVSYDVMNPHDDGISLDVFVDWLIRAGHPIDRVDDYDDWVRRFETALTALPEKRRAQTVLPLLHA
FRAPQAPLRGAPEPTEVFHAAVRTAKVGPGDIPHLDEALIDKYIRDLREFGLI

>uniprot|A0PPD8|A0PPD8_MYCUA Fatty-acid-CoA ligase FadD9 (SEQ ID NO:58)

MSPITREERLERRIQDLYANDPQFAAAKPVTAITAAIERPGLPLPQIIET
VMTGYADRPALAQRSVEFVTDAGTGHTTLRLLPHFETISYGELWDRISAL
ADVLSTEQTVKPSDRVCLLGFNSVDYATIDMTLARLGAVAVPLQTSAAIT
QLQPIVAETQPTMIAASVDALADATELALSGQTATRVLVFDHHRQVDAHR
AAVESARERLAGSAVVETLAEAIARGDVPRGASAGSAPGTDVSDDSLALL
IYTSGSTGAPKGAMYPRRNVATFWRKRTWFEGGYEPSITLNFMPMSHVMG
RQILYGTLCNGGTAYFVVKSDLSTLFEDLALVRPTELTFVPRVWDMVFDE
FQSEVDRRLVDGADRVALEAQVKAEIRNDVLGGRYTSALTGSAPISDEMK
AWVEELLDMHLVEGYGSTEAGMILIDGAIRRPAVLDYKLVDVPDLGYFLT
DRPHPRGELLVKTDSLFPGYYQRAEVTADVFDADGFYRTGDIMAEVGPEQ
FVYLDRRNNVLKLSQGEFVTVSKLEAVFGDSPLVRQIYIYGNSARAYLLA
VIVPTQEALDAVPVEELKARLGDSLQEVAKAAGLQSYEIPRDFIIETTPW
TLQNGLLTGIRKLARPQLKKHYGELLEQIYTDLAHGQADELRSLRQSGAD
APVLVTVCRAAAALLGGSASDVQPDAHFTDLGGDSLSALSFTNLLHEIFD
IDVPVGVIVSPANDLQALADYVEAARKPGSSRPTFASVHGASNEQVTEVH
AGDLSLDKFIDAATLAEAPRLPAANTQVRTVLLTGATGFLGRYLALEWLE
RMDLVDGKLICLVRAKSDTEARARLEKTFDSGAPELLAHYRALAGDHLEV
LAGDKGEADLGLDRQTWQRLADTVDLIVDPAALVNHVLPYSQLFGPNALG
TAELLRLALTSKIKPYSYTSTIGVADQIPPSAFTEDADIRVISATRAVDD
SYANGYSNSKWAGEVLLREAHVLCGLPVAVFRCDMILADTTWAGQLNVPD
MFTRMILSLAATGIAPGSFYELAADGARQRAHYDGLPVEFIAEAISTLGA
QSQDGFHTYHVMNPYDDGIGLDEFVDWLNESGCPIQRIADYGDWLQRFET
ALRALPDRQRHSSLLPLLHNYRQPERPVRGSIAPTDRFRAAVQEAKIGPD
KDIPHVGAPIIVKYVSDLRLLGLL

>gi|227980601|ref|ZP_04027864.1| thioester reductase-like protein
[Tsukamurella paurometabola DSM 20162](SEQ ID NO:59)
MSIETVQNGVPAEGSVPPADQQTERLPQVIARIFAQFADRPAFATREAGPGTPYATVSYREIWRRVTALV
ASWQSEVAPGDFVAILGFTSSDFVTVDLATTLLGAPNVPLQAGAPAARIATILDETRPKILAVSADQVDL
AQEALAESAATPRVVVFDGERDGYEGIEADILSGSALPAPEFFAPEPGTDPLVTLIYTSGSTGTPKGAMY
TEQLVRDAWLKVDSIVDIDMPAESLLHFLPMSHMYGRNWLIAGLASGGTGYFAGASDMSTLFDDLAAARP

FIG. 17 Cont.

TAIGLVPRVCELIHQRYLAVEADTDAETARVELRDRVLGGRLQAAMCGSAALSSELQTFMEWLLGIDIQI
GYGSTEAGGVIRDGVVVRPPVTEYKLIDVPELGYFVTDSPHPRGELLVKSTQLIPGYYNSDKRIRDDEGF
YRTGDVMAELGPDRLEYVDRRSNVIKLAQGEFVPIAQLEAIYAAGPDVHQIFLYGTSERSYLIGVVVPAP
GPDGETDAQTRTRVLDGLAAIARENDLAAYEVPRDVLIERDPFSQENGLRSGIGKLVRPALIARYGDRLH
DLYAQADTRQREGLRALDASGPIIDTVLGAAALTLGADIADFDADTRFGDLGGDSLSALSLATTLEGLYD
VPVPVQTIVGPTATLGGVARHIEKARSGGVAAPTADSVHGVGASVARATDLTLEKFIDPELLALAPTLPA
ATGEPNTVLLTGSTGYLGRFLLLDWLRRVAPHGGTVIALVRGADADDARRRVTAAIGDSDPDLTQEFTSL
AEHHLHVIAGDFGSPALGLDDATWSDLAGRVDHVVHCGALVNHVLPYDQLFGPNVVATGEVVRLALTTRR
KSVDYVSTVAVVPQDDGRVLVEDDDVRELGAERRIGADAYANGYAVSKWAGEVLLHEAADLADLPVRVFR
SDMILAHSRFHGQFNEVDQFTRLLLSIAETGLAPASFYTPDPSGHRPHYDGLPVDFTAEAITTLSAAGRS
GYRTFHVLNANDDGVSLDSFVDWIAASGRSIERIDDYDTWFARFEQALQQLPDEARQRSVLPLLHAVREP
APAAGTSALSVDRFRGAVRETGVGPGDIPVLDRALIEKYLRDFETAGWLAPGARD

>gi|254431429|ref|ZP_05045132.1| putative long-chain fatty-acid--CoA ligase
[Cyanobium sp. PCC 7001] (SEQ ID NO:60)

MNESSADQSSGNVSEGWPDASVTARALQAHLRYEQIIDAILSGYAERPALAERSYLVRPDPSTGQTVRVH
EQAFRSISYRTLQERVHALTMAWRLHPDSPVQAGAFVVLVGFASIDYAVLDLALAYTKGVPVPLSPNHSS
EDDDAILGTVQPVTLAVSISEFSGCVDLIARSTSIRTVIVFDLDPAVDCERAALESGIRALNEKGSDVVV
QTLQDLIDVGRDAEFSFLPIQAQDQDDLALLIHTSGSTGTPKGACISSRALINTWRHVSGPYPKVTVVLA
PFHHMMGRDSMITALGAGGTAYFTLRPDLSTVIEDIRLARPTGLVLFPRLCEVIEHHLTTAPEYSGNEIL
GGRLQSIVVASAPITPRLKASLECLLGVPVSEGYSSTETASGGLAMNGLLNRNNILAYRLRDVPEAGYSV
NDRPFPRGELCVKTRFGISGYFRNPEATAELFDDDGFYCTGDIVEERAPDQIAIIDRRKNVIKLAQGEYV
AVGRLEQLFQEGCGCVQQIHLHGDSTRAYLLAVVVPDRNTLAPPGSRQASEAELKARVREEILTLANQRE
LRGFEIPRDLILAEEPFSQQNGLLSSLGKPIRPAIRARYRSLESLYASHEATRGTELEAIRASAGAVDV
ETTLLALLSSTLGVVCGAADRQTSFRELGGDSLAAVQLAMEIKKQFGVGLEGSQILGPGGTVEAWARRIH
TASIQQAPHQRVGSPLAAIPAEGWLKPDHYRLENLIGIPIGTPSAEVARPTGGPPTVLLTGATGFLGGRL
CLEWLQRLAGQGGRLICLVRPSNSHSAWERLRNRFSHLEPEQVARFRELAGRHLEVIPADIGEPGLGLEP
GCQERLATEVDAICHCAAEVNHRLPYRHLYRPNVIGTAEIIHLAITTRLKSVDFISSIGVASLPRRPGGS
IPVEGGYARGYFASKWACEQLLRSTHDCTGVPVRVIRPSLILPDRVLAGEMNPDDLLSRLLYSILVTGIA
PGCFGEESQNSGRSGFSVQGLPVDQLAQTILALGEARTEGFHVLNLNADSGSGVPLDAILQDIAAKGIRL
RRVEGYDLWLDAITTRLRRLPAEQRARSLLDVAEAYAGSAGQTTQSSGEMQAGSSSCPEEITSLQPDFSR
AYRRKIVDDLARWGLIEPPGPVDQ
>uniprot|A0QIB5|A0QIB5_MYCA1 Putative acyl-CoA dehydrogenase (SEQ ID
NO:61)

MSTATHDERLDRRVHELIATDPQFAAAQPDPAITAALEQPGLRLPQIIRT
VLDGYADRPALGQRVVEFVTDAKTGRTSAQLLPRFETITYGEVAQRVSAL
GRALSDDAVHPGDRVCVLGFNSVDYATIDMALGAIGAVSVPLQTSAAISS
LQPIVAETEPTLIASSVNQLSDAVQLITGAEQAPTRLVVFDYHPQVDDQR
EAVQDAAARLSGTGVAVQTLAELLERGKDLPAVAEPPADEDSLALLIYTS
GSTGAPKGAMYPQSNVGKMWRRGSKNWFGESAASITLNFMPMSHVMGRSI
LYGTLGNGGTAYFAARSDLSTLLEDLELVRPTELNFVPRIWETLYGEFQR
QVERRLSEAGDAGERRAVEAEVLAEQRQYLLGGRFTFAMTGSAPISPELR
NWVESLLEMHLMDGYGSTEAGMVLFDGEIQRPPVVDYKLVDVPDLGYFST
DRPHPRGELLLRTENMFPGYYKRAETTAGVFDEDGYYRTGDVFAEIAPDR
LVYVDRRNNVLKLAQGEFVTLAKLEAVFGNSPLIRQIYVYGNSAQPYLLA
VVVPTEEALASGDPETLKPKIADSLQQVAKEAGLQSYEVPRDFIIETTPF
SLENGLLTGIRKLAWPKLKQHYGERLEQMYADLAAGQADELAELRRNGAQ
APVLQTVSRAAGAMLGSAASDLSPDAHFTDLGGDSLSALTFGNLLREIFD
VDVPVGVIVSPANDLAAIASYIEAERQGSKRPTFASVHGRDATVVRAADL
TLDKFLDADTLASAPNLPKPATEVRTVLLTGATGFLGRYLALEWLERMDM
VDGKVIALVRARSDEEARARLDKTFDSGDPKLLAHYQQLAADHLEVIAGD
KGEANLGLRQDVWQRLADTVDVIVDPAALVNHVLPYSELFGPNALGTAEL
IRLALTSKQKPYTYVSTIGVGDQIEPGKFVENADIRQMSATRAINDSYAN
GYGNSKWAGEVLLREAHDLCGLPVAVFRCDMILADTTYAGQLNLPDMFTR
LMLSLVATGIAPGSFYELDADGNRQRAHYDGLPVEFIAAAISTLGSQITD

FIG. 17 Cont.

```
SDTGFQTYHVMNPYDDGIGLDEYVDWLVDAGYSIERIADYSEWLRRFETS
LRALPDRQRQYSLLPLLHNYRTPEKPINGSIAPTDVFRAAVQEAKIGPDK
DIPHVSPPVIVKYITDLQLLGLL
>uniprot|A0QWI7|A0QWI7_MYCS2 NAD dependent epimerase/dehydratase
family protein (SEQ ID NO:62)

MTIETREDRFNRRIDHLFETDPQFAAARPDEAISAAAADPELRLPAAVKQ
ILAGYADRPALGKRAVEFVTDEEGRITAKLLPRFDTITYRQLAGRIQAVT
NAWHNHPVNAGDRVAILGFTSVDYTTIDIALLELGAVSVPLQTSAPVAQL
QPIVAETEPKVIASSVDFLADAVALVESGPAPSRLVVFDYSHEVDDQREA
FEAAKGKLAGTGVVVETITDALDRGRSLADAPLYVPDEADPLTLLIYTSG
STGTPKGAMYPESKTATMWQAGSKARWDETLGVMPSITLNFMPMSHVMGR
GILCSTLASGGTAYFAARSDLSTFLEDLALVRPTQLNFVPRIWDMLFQEY
QSRLDNRRAEGSEDRAEAAVLEEVRTQLLGGRFVSALTGSAPISAEMKSW
VEDLLDMHLLEGYGSTEAGAVFIDGQIQRPPVIDYKLVDVPDLGYFATDR
PYPRGELLVKSEQMFPGYYKRPEITAEMFDEDGYYRTGDIVAELGPDHLE
YLDRRNNVLKLSQGEFVTVSKLEAVFGDSPLVRQIYVYGNSARSYLLAVV
VPTEEALSRWDGDELKSRISDSLQDAARAAGLQSYEIPRDFLVETTPFTL
ENGLLTGIRKLARPKLKAHYGERLEQLYTDLAEGQANELRELRRNGADRP
VVETVSRAAVALLGASVTDLRSDAHFTDLGGDSLSALSFSNLLHEIFDVD
VPVGVIVSPATDLAGVAAYIEGELRGSKRPTYASVHGRDATEVRARDLAL
GKFIDAKTLSAAPGLPRSGTEIRTVLLTGATGFLGRYLALEWLERMDLVD
GKVICLVRARSDDEARARLDATFDTGDATLLEHYRALAADHLEVIAGDKG
EADLGLDHDTWQRLADTVDLIVDPAALVNHVLPYSQMFGPNALGTAELIR
IALTTTIKPYVYVSTIGVGQGISPEAFVEDADIREISATRRVDDSYANGY
GNSKWAGEVLLREAHDWCGLPVSVFRCDMILADTTYSGQLNLPDMFTRLM
LSLVATGIAPGSFYELDADGNRQRAHYDGLPVEFIAEAISTIGSQVTDGF
ETFHVMNPYDDGIGLDEYVDWLIEAGYPVHRVDDYATWLSRFETALRALP
ERQRQASLLPLLHNYQQPSPPVCGAMAPTDRFRAAVQDAKIGPDKDIPHV
TADVIVKYISNLQMLGLL

>gi|254819907|ref|ZP_05224908.1| FadD9 [Mycobacterium intracellulare
ATCC 13950](SEQ ID NO:63)

MSTAIHDEHLDRRIEELIANDPQFAAARPDPAITAATEAPGLRLPQIIRTVLDGYADRPALAQRVVEFVT
DAKTGRTTAELLPRFETITYGELGERVSALGRAWAGDAVRPGDRVCVLGFNSVDYATIDIALGTIGAVSV
PLQTSAAISSLQPIVAETEPSLIASSVNQLPDAVELILAGDHVPGKLVVFDYQPQVDDQREAVEAAAARL
ADSGVAVEALADVLRRGKDLPAVEPPASDEDSLALLIYTSGSTGAPKGAMYPQSNVGKMWRRGSKNWFGE
SAASITLNFMPMSHVMGRGILYGTLGNGGTAYFAARSDLSTLLEDLELVRPTEMNFVPRIWETLYGEFQR
QVERRLADGDAGPEARETVAAAVLEEQRQYLLGGRFIFAMTGSAPTSPELKAWAESLLQMHLMDGYGSTE
AGMVLFDGEIQRPPVIDYKLVDVPDLGYFSTDRPHPRGELLLRTENMFPGYYKRAETTANVFDEDGYYRT
GDVFAEIAPDRLVYVDRRNNVLKLAQGEFVTLAKLEAVFGNSPLIRQIYVYGNSSQPYLLAVVVPTEEAL
ADNDLESLKPKIADSLQKVAKETGLQSYEVPRDFIIETTPFTLENGLLTGIRKLAWPKLKAHYGDRLEQM
YAELAAGQANELAELRRSGAAAPVAQTVSRAAAALLGATAGDLSADAHFTDLGGDSLSALTFGNLLREIF
DVDVPVGVIVSPANDLAGIAAYIEAERQGSKRPTFAAVHGRGATMVHASDLTLDKFLDEATLAAAPSLPK
PATEVRTVLLTGATGFLGRYLALDWLERMDMVDGKVIALVRARTDEEARARLDKTFDSGDPKLLAHYQRL
AADHLEVIAGDKGEANLGLDPQTWQRLAEEVDVIVDPAALVNHVLPYSELFGPNALGTAELIRIALTSRQ
KPYTYVSTIGVGDQIQPGEFVENADIRQISATREINDGYANGYGNSKWAGEVLLREAHDLCGLPVTVFRC
DMILADTTYAGQLNLPDMFTRLMLSLVATGIAPGSFYELDADGNRQRAHYDGLPVEFIAAAISTLGTQIT
DSDTGFQTYHVMNPYDDGIGLDEYIDWLIEAGYSIERIADYSEWLRRFETSLRALPDRQRQYSLLPLLHN
YQKPEKPINGSMAPTDVFRAAVQEAKIGPDKDIPHVSAPVIVKYITDLELLGLL
```

FIG. 17 Cont.

>uniprot|A0R484|A0R484_MYCS2 Putative long-chain fatty-acid--CoA ligase (SEQ ID NO:64)

MTSDVHDATDGVIETALDDEQSTRRIAELYATDPEFAAAAPLPAVVDAAH
KPGLRLAEILQTLFTGYGDRPALGYRARELATDEGGRTVTRLLPRFDTLT
YAQVWSRVQAVAAALRHNFAQPIYPGDAVATIGFASPDYLTLDLVCAYLG
LVSVPLQHNAPVSRLAPILAEVEPRILTVSAEYLDLAVESVRDVNSVSQL
VVFDHHPEVDDHRDALARAREQLAGKGIAVTTLDAIADEGAGLPAEPIYT
ADHDQRLAMILYTSGSTGAPKGAMYTEAMVARLWTMSFITGDPTPVINVN
FMPLNHLGGRIPISTAVQNGGTSYFVPESDMSTLFEDLALVRPTELGLVP
RVADMLYQHHLATVDRLVTQGADELTAEKQAGAELREQVLGGRVITGFVS
TAPLAAEMRAFLDITLGAHIVDGYGLTETGAVTRDGVIVRPPVIDYKLID
VPELGYFSTDKPYPRGELLVRSQTLTPGYYKRPEVTASVFDRDGYYHTGD
VMAETAPDHLVYVDRRNNVLKLAQGEFVAVANLEAVFSGAALVRQIFVYG
NSERSFLLAVVVPTPEALEQYDPAALKAALADSLQRTARDAELQSYEVPA
DFIVETEPFSAANGLLSGVGKLLRPNLKDRYGQRLEQMYADIAATQANQL
RELRRAAATQPVIDTLTQAAATILGTGSEVASDAHFTDLGGDSLSALTLS
NLLSDFFGFEVPVGTIVNPATNLAQLAQHIEAQRTAGDRRPSFTTVHGAD
ATEIRASELTLDKFIDAETLRAAPGLPKVTTEPRTVLLSGANGWLGRFLT
LQWLERLAPVGGTLITIVRGRDDAAARARLTQAYDTDPELSRRFAELADR
HLRVVAGDIGDPNLGLTPEIWHRLAAEVDLVVHPAALVNHVLPYRQLFGP
NVVGTAEVIKLALTERIKPVTYLSTVSVAMGIPDFEEDGDIRTVSPVRPL
DGGYANGYGNSKWAGEVLLREAHDLCGLPVATFRSDMILAHPRYRGQVNV
PDMFTRLLLSLLITGVAPRSFYIGDGERPRAHYPGLTVDFVAEAVTILGA
QQREGYVSYDVMNPHDDGISLDVFVDWLIRAGHPIDRVDDYDDWVRRFET
ALTALPEKRRAQTVLPLLHAFRAPQAPLRGAPEPTEVFHAAVRTAKVGPG
DIPHLDEALIDKYIRDLREFGLI

>gi|240173202|ref|ZP_04751860.1| FadD9 [Mycobacterium kansasii ATCC 12478](SEQ ID NO:65)
MSTTTRDERLERRIDTLIHDDAQFAAAKPDPAIAAALEKPGLSLPEIIQTALQGYADRPALGQRAVEFVT
DTQTGRTSVRLLTRFETITYRQLGDRVGALARALTHDSVHAGDRVCVLGFNSLDYTTIDMALAKVGAVSV
PLQTSAAVTQLQPIVAETEPTMMAASVNQLSDAVDVLLSGHLPAKLVVFDYHPEVDDQREALDTARERLA
DTAVVVQTLKDVLDHGATLAAGSVAEPLAASGDNDSLALLIYTSGSTGAPKGAMYRQSNVGKMWRRSSKN
WFGPTAASITLNFMPMSHIMGRGVLYGTLGNGGTAYFAARSDLSTLLEDLRLVRPTELNFVPRIWETLYG
EYQRAVDQRSVDPGEPAAREAVEAQVMAEQRQDLLGGRYIFAMTGSAPMSPELRNWVEALLEIPLLDGYG
STEAGMVMFDGEIQRPPVIDYKLVDVPDLGYFSTDQPYPRGELLLKTENMFPGYYKRPEVTASVFDADGY
YRTGDVVAEVAPDRLVYVDRRNNVLKLAQGEFVTVAKLEAVFGNSPLVRQIYVYGNSAHPYLLAVVVPTE
EASAGTDIAALKPLIADSLQTVAKEAGLQSYEVPRDFLIETTPFTLENGLLTGIRKLAWPKLRQHYGERL
EQLYTELAASQANELSELRRSGAHAPVLETVSRAAGALLGAASTALSPDAHFTDLGGDSLSALTFGNLLR
EIFDVDVPVGVIVSPASDLAAIAAYIEGERQGSKRPTFAVIHGRDALEVHASDLTLDKFIDASTLAAAPV
LPPPSAAVRTVLLTGATGFLGRYLALDWLERMDLVDGKVIALVRAKSDDDARARLDKTFDSGDPELLTHY
RRLATDHLEVIAGDKGEANLGLDQLTWQRLADTVDLIVDPAALVNHVLPYSELFGPNALGTAELIRIALT
GKLKPYTYVSTIGVGDQIEPGKFTEDADIRHISATRKINDSYANGYGNSKWAGEVLLREAHDLCGLPVAV
FRCDMILADTIWAGQLNVPDMFTRMMLSLVATGIAPGSFYELDADGNRQRAHYDGLPVEFIAEAIATLGA
RDGKGFQTYHVMNPYDDGIGMDRFVDWLVDAGCAIHRIDDYGDWLRRFETALRGLPEKQRHASLLPLLHN
YQKPAPPLRGSMAPTDRFRAAVQDAKVGPDKDIPHISPQIIAKYLSDLRLLGLL >uniprot|A1KLT8|A1KLT8_MYCBP Probable fatty-acid-CoA ligase fadD9 (SEQ ID NO:66)

MSINDQRLTRRVEDLYASDAQFAAASPNEAITQAIDQPGVALPQLIRMVM
EGYADRPALGQRALRFVTDPDSGRTMVELLPRFETITYRELWARAGTLAT
ALSAEPAIRPGDRVCVLGFNSVDYTTIDIALIRLGAVSVPLQTSAPVTGL

FIG. 17 Cont.

```
RPIVTETEPTMIATSIDNLGDAVEVLAGHAPARLVVFDYHGKVDTHREAV
EAARARLAGSVTIDTLAELIERGRALPATPIADSADDALALLIYTSGSTG
APKGAMYRESQVMSFWRKSSGWFEPSGYPSITLNFMPMSHVGGRQVLYGT
LSNGGTAYYVAKSDLSTLFEDLALVRPTELCFVPRIWDMVFAEFHSEVDR
RLVDGADRAALEAQVKAELRENVLGGRFVMALTGSAPISAEMTAWVESLL
ADVHLVEGYGSTEAGMVLNDGMVRRPAVIDYKLVDVPELGYFGTDQPYPR
GELLVKTQTMFPGYYQRPDVTAEVFDPDGFYRTGDIMAKVGPDQFVYLDR
RNNVLKLSQGEFIAVSKLEAVFGDSPLVRQIFIYGNSARAYPLAVVVPSG
DALSRHGIENLKPVISESLQEVARAAGLQSYEIPRDFIIETTPFTLENGL
LTGIRKLARPQLKKFYGERLERLYTELADSQSNELRELRQSGPDAPVLPT
LCRAAAALLGSTAADVRPDAHFADLGGDSLSALSLANLLHEIFGVDVPVG
VIVSPASDLRALADHIEAARTGVRRPSFASIHGRSATEVHASDLTLDKFI
DAATLAAAPNLPAPSAQVRTVLLTGATGFLGRYLALEWLDRMDLVNGKLI
CLVRARSDEEAQARLDATFDSGDPYLVRHYRELGAGRLEVLAGDKGEADL
GLDRVTWQRLADTVDLIVDPAALVNHVLPYSQLFGPNAAGTAELLRLALT
GKRKPYIYTSTIAVGEQIPPEAFTEDADIRAISPTRRIDDSYANGYANSK
WAGEVLLREAHEQCGLPVTVFRCDMILADTSYTGQLNLPDMFTRLMLSLA
ATGIAPGSFYELDAHGNRQRAHYDGLPVEFVAEAICTLGTHSPDRFVTYH
VMNPYDDGIGLDEFVDWLNSPTSGSGCTIQRIADYGEWLQRFETSLRALP
DRQRHASLLPLLHNYREPAKPICGSIAPTDQFRAAVQEAKIGPDKDIPHL
TAAIIAKYISNLRLLGLL

>gi|254822803|ref|ZP_05227804.1| putative long-chain fatty-acid--CoA
ligase [Mycobacterium intracellulare ATCC 13950] (SEQ ID NO:67)

MAATDEQFRNAQPDLSLQQAARQPGLRLPQILELFVEGYADRPAVGWRARTLSTDPATGRTTTRLLPRFD
TMTYRELWADVRAIAAAWRHDAANPVSPGDFVATVGFASAEYLTLDLVCGYLGLVAVPLQHNTTPSRLRP
IVDEVEPSILAAGVGYLDLAVEAASGSSSLRRLVVFDYQPEVDEQREALQRAQATLAAAGAAVTIETLDE
IIERGRALPPEPMYTGDTDQRLAMIMYTSGSTGLPKGAMYTEQMLAKVWTNELMPDFADTPVFNVNFMPL
NHLGGRIPLSTAFQAGGTSYFVPESDLSTLFDDWNLVRPTEMGLVPRVAEMLYQRYQSAVDRLVASGADA
GSAEARARAELREHVLGGRIVTAFCGTAPLAAEMRAFVETCLDVHVLDGYGLTEVGMVTKDGRMTRPPVL
DYKLIDVPELGYFHTDKPYPRGELLVKSLTATPGYFKRPDVTANAFDPDGYYRTGDVMAELEPDRLAYVD
RRNNVLKLAQGEFVAVARLEAVFASAPLIRQIFVYGNSERPYLLAVVVPTADAAERFTGDPEGLKAAVAE
SLRQSAQLAELQSYEVPVDFVVETEPFSEDNGLLSGVGKLLRPKLKERYADRLEQLYAELAENRVTELRA
LREGADKHPVVFTLTRAAEALLGVAGGPPAPDALFIELGGDSLSALTFSNLLRDIFDVDVPVGMITGPAT
DLGGQLAEYVESERKSGSRRPTFATVHGRGAAEVRAAELTLDKFIDATTLAAAPNLPRATGTPHTVLLTGA
NGYLGRFLALEWLERLAETGGKLVSIVRATDTAAAVKRLEAVFDSGDPQLLERFRTLAAEHLEVIVGDIG
EPNLGLDQATWQRLAQSVDLIVHPAALVNHVLPYDQLFGPNVVGTAELIRLAITTRIKPVTYLSTVAVAM
TVDPGEFAEDGDIRAVSAVRPIDDSYANGYANSKWAGEVLLREAHDLCGLPVAVFRSDMILAHSRYAGQL
NVPDAFTRLMFSLLTTGIAPTTFYRTDEHGNRAVAHYDGLPADFVAEAVTTLGEQMAAEESGGYRSYDVM
NPHDDGVSLDVFVDWLIAAGHDIRRIEDYDEWLGRFTTALRALPDKQRQHSVLPLLDAYREPATPLRGAP
APTDVFRHAVRTAKIGADEDIPHLSAALIDKYVADLRLLGLV

>uniprot|A1QUM2|A1QUM2_MYCTF Fatty-acid-CoA ligase fadD9 (SEQ ID
NO:68)

MSINDQRLTRRVEDLYASDAQFAAASPNEAITQAIDQPGVALPQLIRMVM
EGYADRPALGQRALRFVTDPDSGRTMVELLPRFETITYRELWARAGTLAT
ALSAEPAIRPGDRVCVLGFNSVDYTTIDIALIRLGAVSVPLQTSAPVTGL
RPIVTETEPTMIATSIDNLGDAVEVLAGHAPARLVVFDYHGKVDTHREAV
EAARARLAGSVTIDTLAELIERGRALPATPIADSADDALALLIYTSGSTG
APKGAMYRESQVMSFWRKSSGWFEPSGYPSITLNFMPMSHVGGRQVLYGT
LSNGGTAYFVAKSDLSTLFEDLALVRPTELCFVPRIWDMVFAEFHSEVDR
```

FIG. 17 Cont.

```
RLVDGADRAALEAQVKAELRENVLGGRFVMALTGSAPISAEMTAWVESLL
ADVHLVEGYGSTEAGMVLNDGMVRRPAVIDYKLVDVPELGYFGTDQPYPR
GELLVKTQTMFPGYYQRPDVTAEVFDPDGFYRTGDIMAKVGPDQFVYLDR
RNNVLKLSQGEFIAVSKLEAVFGDSPLVRQIFIYGNSARAYPLAVVVPSG
DALSRHGIENLKPVISESLQEVARAAGLQSYEIPRDFIIETTPFTLENGL
LTGIRKLARPQLKKFYGERLERLYTELADSQSNELRELRQSGPDAPVLPT
LCRAAAALLGSTAADVRPDAHFADLGGDSLSALSLANLLHEIFGVDVPVG
VIVSPASDLRALADHIEAARTGVRRPSFASIHGRSATEVHASDLTLDKFI
DAATLAAAPNLPAPSAQVRTVLLTGATGFLGRYLALEWLDRMDLVNGKLI
CLVRARSDEEAQARLDATFDSGDPYLVRHYRELGAGRLEVLAGDKGEADL
GLDRVTWQRLADTVDLIVDPAALVNHVLPYSQLFGPNAAGTAELLRLALT
GKRKPYIYTSTIAVGEQIPPEAFTEDADIRAISPTRRIDDSYANGYANSK
WAGEVLLREAHEQCGLPVTVFRCDMILADTSYTGQLNLPDMFTRLMLSLA
ATGIAPGSFYELDAHGNRQRAHYDGLPVEFVAEAICTLGTHSPDRFVTYH
VMNPYDDGIGLDEFVDWLNSPTSGSGCTIQRIADYGEWLQRFETSLRALP
DRQRHASLLPLLHNYREPAKPICGSIAPTDQFRAAVQEAKIGPDKDIPHL
TAAIIAKYISNLRLLGLL

>uniprot|A1T887|A1T887_MYCVP Thioester reductase domain (SEQ ID NO:69)
MSTDTREDRLARRIADLYATDPQFAAAAPDDAISHAIDQPGTHLPVIVQT
VLDGYAERPALGQRAVRFVTDPATGRTTTELLPRFETITYAELSRRIHAV
TAALTDVHPGDRVAVLGFTSIDYTTVDMALAMLGAVAVPLQTSAPATTVR
PIVAETEPVVIASSVDALTDAVGLALDAPTVTRLVVFDHRAGVDDHRDAL
ISASDRLRAANSPIEVETITDIVARGSKLPVRAQFSADGDALSLLIYTSG
STGAPKGAMYPQHLVANSWRRLARSFWGDLGVFPAITLNFMPMSHVMGRG
LLYGTLDAGGTAYFAARSDLSTFLEDLALVRPTQLSFVPRIWDTIHAEVS
QELERRPSDATEVIADLRRSLLGGRYVTAMTGSAPLSPEMRAFVENLLDV
HLIDGYGSTEAGAVFVDGRVQRPPVIDYKLVDVADLGYFSTDRPHPRGEL
LVKSETLFPGYYKRPDVTAEMFDEDGYYRTGDIVAETGADQLTYLDRRNN
VLKLSQGEFVTVSRLEAVFGNSPLVRQIYVYGNSARPYLLAVVVPTEAAL
AGADAKAAVAESLQDVAKATGLQSYEIPRDFLLETTPFTLENGLLTGIRK
LARPRLRERYGEQLEALYTMLSEEQADELRELRRSGGERPALETVGRAAG
ALLGTTAGELEPSAHFTDLGGDSLSALTFANLLRDIFDVDVPVGVIVSPA
TDLQALADYVESARRHGSVRPTFESVHGHSGRPGTEVHARDLTLDEFVDA
ATLAHAPTLPGPRAEVRTVLLTGATGFLGRYLALEWLERMALVGGKLICL
VRAKDDAAARVRLDSTFDSGDPELLRHYRRLAADHLEVIAGDKADADLGL
DARTWQRLADTVDLIVDPAALVNHVLPYRQLFAPNVLGTAELLRIALTTR
MKPFVYVSTIGVGAGIEPARFTEDADIRQISATRRIDDSYANGYGNSKWA
GEVLLREAHDLCGLPVSVFRCDMILADTTYAGQLNLPDMFTRLIFSLVAT
GVAPESFYHLATDGTRQRAHYDGLPVEFIAEAISTLGSDVASGFRTYHVM
NPHDDGIGLDEYVDWLIDAGHPIRRVGDYPTWLQRFTVAITALPERQRQA
SLLPLLHNYQHPETPIRGSIAPTDRFREAVQDAKIGPDKDIPHVTPQIVI
KYVTDLQRLGLL >uniprot|A1UFA8|A1UFA8_MYCSK Thioester reductase domain (SEQ ID NO:70)
MSTETREARLQQRIAHLFTTDPQFAAARPDPRISDAVDRDDTRLTAIVSA
VMSGYADRPALGQRAAEFVTDPQTGRTTMELLPRFDTITYRELLDRVRAL
TNAWHADGVRPGDRVAILGFTGIDYTVVDLALIQLGAVAVPLQTSAAVEA
LRPIVAETEPMLIATGVDHVDAAAELALTGHRPSRVVVFDHREQVDDERD
AVRAATARLGDAVPVETLAEVLRRGAHLPAVAPHVFDEADPLRLLIYTSG
SAGAPKGAMYPESKVAGMWRASAKAAWNNDQTAIPSITLNFLPMSHVMGR
GLLCGTLSTGGTAYFAARSDLSTLLEDLRLVRPTQLSFVPRIWDMLFQEF
VGEVDRRVNDGADRPTAEADVLAVQRHELLGGRFVTAMTGSAPISLEMKT
```

FIG. 17 Cont.

```
WVETLLDMHLVEGYGSTEAGAVFVDGHIQRPPVLDYKLVDVPDLGYFSTD
RPHPRGELLVRSTQLFPGYYKRPDVTAEVFDDDGFYRTGDIVAEVGPDQV
QYLDRRNNVLKLAQGEFVTISKLEAVFAGSALVRQIYVYGNSARSYLLAV
VVPTDDAVARHDPASLKTAISASLQQAAKTAGLQSYELPRDFLVETQPFT
LENGLLTGIRKLARPKLKARYGDRLEALYVELVEGQAGELRTLRRDGAKR
PVAETVGRAAAALLGAAAADVRPDAHFTDLGGDSLSALTFGNLLQEIFGV
DVPVGVIVSPAADLASIAAYIEAEQASTGKRPTYASVHGRDAEQVHARDL
TLDKFIDAETLSAATELPGPSGEVRTVLLTGATGFLGRYLALDWLERMAL
VDGKVICLVRAKDDAAARKRLDDTFDSGDPKLLAHYRKLAADHLEVLAGD
KGEADLGLPHPVWQRLADTVDLIVDPAALVNHVLPYSQLFGPNALGTAEL
IRLALTTRIKPFTYVSTIGVGAGIEPGRFTEDDDIRVISPTRAVDTGYAN
GYGNSKWAGEVLLREAHDLCGLPVAVFRCDMILADTTYAGQLNLPDMFTR
MMLSLVTTGIAPKSFHPLDAKGHRQSAHYDGLPVEFVAESISALGAQAVD
EAGTGFATYHVMNPHDDGIGLDEFVDWLVEAGYRIDRIDYYAAWLQRFET
ALRALPERTRQYSLLPLLHNYQRPAHPINGAMAPTDRFRAAVQEAKLGPD
KDIPHVTPAVIVKYATDLELLGLI

>gi|254775919|ref|ZP_05217435.1| FadD9 [Mycobacterium avium subsp.
avium ATCC 25291] (SEQ ID NO:71)
MSTATHDERLDRRVHELIATDPQFAAAQPDPAITAALEQPGLRLPQIIRTVLDGYADRPALGQRVVEFVT
DAKTGRTSAQLLPRFETITYGEVAQRVSALGRALSDDAVHPGDRVCVLGFNSVDYATIDMALGAIGAVSV
PLQTSAAISSLQPIVAETEPTLIASSVNQLSDAVQLITGAEQAPTRLVVFDYHPQVDDQREAVQDAAARL
SSTGVAVQTLAELLERGKDLPAVGEPPADEDSLALLIYTSGSTGAPKGAMYPQSNVGKMWRRGSKNWFGE
SAASITLNFMPMSHVMGRSILYGTLGNGGTAYFAARSDLSTLLEDLELVRPTELNFVPRIWETLYGEFQR
QVERRLSESGDAGERRAVEAEVLAEQRQYLLGGRFTFAMTGSAPISPELRNWVESLLEMHLMDGYGSTEA
GMVLFDGEIQRPPVIDYKLVDVPDLGYFSTDRPHPRGELLLRTENMFPGYYKRAETTAGVFDEDGYYRTG
DVFAEIAPDRLVYVDRRNNVLKLAQGEFVTLAKLEAVFGNSPLIRQIYVYGNSAQPYLLAVVVPTEEALA
SGDPETLKPKIADSLQQVAKEAGLQSYEVPRDFIIETTPFSLENGLLTGIRKLAWPKLKQHYGERLEQMY
ADLAAGQANELAELRRNGAQAPVLQTVSRAAGAMLGSAASDLSPDAHFTDLGGDSLSALTFGNLLREIFD
VDVPVGVIVSPANDLAAIASYIEAERQGSKRPTFASVHGRDATVVRAADLTLDKFLDAETLAAAPNLPKP
ATEVRTVLLTGATGFLGRYLALEWLERMDMVDGKVIALVRARSDEEARARLDKTFDSGDPKLLAHYQQLA
ADHLEVIAGDKGEANLGLGQDVWQRLADTVDVIVDPAALVNHVLPYSELFGPNALGTAELIRLALTSKQK
PYTYVSTIGVGDQIEPGKFVENADIRQMSATRAINDSYANGYGNSKWAGEVLLREAHDLCGLPVAVFRCD
MILADTTYAGQLNLPDMFTRLMLSLVATGIAPGSFYELDADGNRQRAHYDGLPVEFIAAAISTLGSQITD
SDTGFQTYHVMNPYDDGIGLDEYVDWLVDAGYSIERIADYSEWLRRFETSLRALPDRQRQYSLLPLLHNY
RTPEKPINGSIAPTDVFRAAVQEAKIGPDKDIPHVSPPVIVKYITDLQLLGLL >uniprot|A3PYW9|A3PYW9_MYCSJ Thioester reductase domain (SEQ ID NO:72)

MSTETREARLQQRIAHLFATDPQFAAARPDPRISDAVDRDDARLTAIVSA
VMSGYADRPALGQRAAEFATDPQTGRTTMELLPRFDTITYRELLDRVRAL
TNAWHADGVRPGDRVAILGFTGIDYTVVDLALIQLGAVAVPLQTSAAVEA
LRPIVAETEPMLIATGVDHVDAAAELALTGHRPSQVVVFDHREQVDDERD
AVRAATARLGDAVPVETLAEVLRRGAHLPAVAPHVFDEADPLRLLIYTSG
STGAPKGAMYPESKVAGMWRASAKAAWNNDQTAIPSITLNFLPMSHVMGR
GLLCGTLSTGGTAYFAARSDLSTLLEDLRLVRPTQLSFVPRIWDMLFQEF
VGEVDRRVNDGADRPTAEADVLAELRQELLGGRFVTAMTGSAPISPEMKT
WVETLLDMHLVEGYGSTEAGAVFVDGHIQRPPVLDYKLVDVPDLGYFSTD
RPHPRGELLVRSTQLFPGYYKRPDVTAEVFDDDGFYRTGDIVAELGPDQL
QYLDRRNNVLKLAQGEFVTISKLEAVFAGSALVRQIFVYGNSARSYLLAV
VVPTDDAVARHDPASLKTAISASLQQAAKTAGLQSYELPRDFLVETQPFT
LENGLLTGIRKLARPKLKARYGDRLEALYVELAEGQAGELRTLRRDGAKR
PVAETVGRAAAALLGAAAADVRPDAHFTDLGGDSLSALTFGNLLQEIFGV
DVPVGVIVSPAADLASIAAYIETEQASTGKRPTYASVHGRDAEQVRARDL
```

FIG. 17 Cont.

```
TLDKFIDAETLSAATELPVPIGEVRTVLLTGATGFLGRYLALDWLERMAL
VDGKVICLVRAKDDAAARKRLDDTFDSGDPKLLAHYRKLAADHLEVLAGD
KGEADLGLPHQVWQRLADTVDLIVDPAALVNHVLPYSQLFGPNALGTAEL
IRLALTTRIKPFTYVSTIGVGAGIEPGRFTEDDDIRVISPTRAVDTGYAN
GYGNSKWAGEVLLREAHDLCGLPVAVFRCDMILADTTYAGQLNLPDMFTR
MMVSLVTTGIAPKSFHPLDAKGHRQRAHYDGLPVEFVAESISALGAQAVD
EAGTGFATYHVMNPHDDGIGLDEFVDWLVEAGYRIDRIDDYAAWLQRFET
ALRALPERTRQYSLLPLLHNYQRPAHPINGAMAPTDRFRAAVQEAKLGPD
KDIPHVTPGVIVKYATDLELLGLI
```

>gi|219932734|emb|CAR70557.1| hypothetical protein [Mycobacterium leprae Br4923] (SEQ ID NO:73)

```
MSTVDGVCDEDIYYYYDCIYCAADVASPTGYLPGGLFSLAKLLVIRGEKQYVFGLNDSTSVGPGPGNMPW
LDDPGLSAVIASSVAAAELAAARSW
```

>uniprot|A5CM59|A5CM59_CLAM3 Putative acyl-CoA synthetase (SEQ ID NO:74)

```
MSTEQMGTEQMGSQHEDTSIEAIFAQHADRTALRQRSGPDITDMGFRELW
DRAGALAAALGETVSAGDRIAVLGTATADAVTLDLAAWILGAVSVPLQAS
APVAALRAIVEETTPVWIAATADQAATARAVAEASGDGIRTMRLDTDTDA
DTDTDAALTLGALVARGAGLRRRSPWHPAPGDDPLALLLYTSGSTGTPKG
AMYTRSMVERMWHALRPDPAAPADASTTADDGDAAAIVGYAYLPMSHLTG
RSSLLATLGRGGTVALATSTDLSTLFDDLRTFAPTEFVFVPRVAELVRQE
GDREEQRRLTAGSTDRDAVRAEVQADLRARAFGGRIHRAICTSAPLTPEL
RTYIEGCLGLTLHDLYGSTEAGGILHDGVIQQPPVTEHKLVDVPELGYRT
TDRPHPRGELLVKSASVIAGYFRRPDVTAAVFDEDGFYRTGDVMAQTGPG
TYEYVDRRNNVIKLSQGEFVAVASLEATYGGTPEVHQIALHGDSRHAFLV
AVVVPADPAASERDILAALQRTAREHGLAPYEVPRGVIVEPDPFTVDGGM
LSDAGKLLRLRLTQRYGERLAALYDALEEQQSGTLVAALRERADDEPTVD
TVVRAALLLLGAEVSPATAAAARFSDLGGDSLSALTFSGILEDVFGTEVP
VGVLTDPTNDLAAVAAYVERSASDDRPTVTRVHGAGASTLRVGDLRLDRM
LGGIPTPVPRASAARPGSRTVLLTGANGYLGRFLAIDWLERLAATGGTLV
CIVRGADDADARRRLEAAFAADPAFARRFAELSGSLEVLAGDVSEHRLGL
DDERWIDLAARVDLVAHAAALVNHVLPYSALFGPNVVGTAEAIRLAIAAG
SVPVTFVSSVAVAGGARPGATADAEPSAPGALDEHADIRATIPEWAVGDE
YANGYGASKWASEVLLREAHEHHGVPVAVFRSDMILAHPRWRGQVNLPDV
FTRLIWSVLTTGLAPASFVRRGPDGERQRSHYDGLPADFTAAAIDGIGAA
LTEGHRTFNVVNPHDDGVSLDTFVDWIREDGHDIARVDDHAEWVDRFRAA
LGALPDADRARSVLPLMHAFASPEEPHAGSAIPADAFAEAVRAVRPLGSP
DIPSLDHALIAKVADDLAFLGLLAPARAAAA
```

>uniprot|A8M8D3|A8M8D3_SALAI Thioester reductase domain (SEQ ID NO:75)

```
VTTTEQTLTERLIAEDEQIRRAQVSAEVSAAMRVPGMSQAQIVAAGFTGY
ADRAALGERAREAVTDPVTGRTTHRLLPWFDTITYGEVRSRVLAISAAWW
HDVDAPLRPGAFVVSVGVPSADLVTVELAVLHTGAVSVPLQVSSTAEQLR
PILDEAAPLIVATSVDRLAVVTAAMSGNASVRRIMVLNHDAAITAHRDAV
DAARSALAGTAVVVHTLTEVLDRGRGLPAPEPYAAPTGEDPLSLLIYTSG
STGTPKGAMFPESMTRANWVRFDPKPTDMAVIRLNYLPLSHNVGRIVLFE
ALAVGGIAFFTAHSDLSTLLEDMALARPTDLFLIPRLCDMLAQRHDSELA
```

FIG. 17 Cont.

```
RRRITTADHEGVRQVHTHLREAVLGGRVTRAMSLSAPLSPQLRRFVESCL
GFAVHDVFGSTEAGGLLVNGRVLRPPVLDYRLVDVPDLGYFTTDRPYPRG
ELLVRTATIIPGYYQRPELNAELFTEDGYYRTGDIMAEYGPDHLGYVDRT
TSVLKLSQGEFVAVSRLEELFAASPLIRQIYLYGNSERPYLLAVVVPTEE
AHAATREPAALKAVLGESLQRIAQQHGLHPYEVPRDLLIETTPFSTANGL
LSDIRKPLRPKLKTRYAPRLEALYTELAEREADRIRTLRDAGSAQPVLPA
LREAARAFLGRPGAALDVNDRFVDLGGDSLSALALSNLLSDIFEVRVPVG
IMISATGTLGSVAAWIEAERATAGAGIGRATPTSVHGANLTQVHADDLIL
GTFLDVTTLAAAACLPRAPLSDPRVVLLTGATGYLGRFLALEWLDRLSRS
GGTLVCVVRAADDAEAARRLESVYGSSDPELLERFRSLAGHVRVLAGDVA
EARFGLPAGVWQELAETVDLIVHSAALVNHVLPYEQLFGPNVAGTAELVR
LAVSVRVKGIAFLSTVAVITSQTTTPDEDADIRQASPHRVLDDSYANGYA
ASKWAGEVLLRRAHEEYGVPVSVFRSDVILAHSRYAGQLNVPDMFTRLLL
SILATGIAPASFYRTGPDGERQPAHYDGLPVDFTAAAVAAVGVTEGHRTF
NVLNPHEDGIGLDTFVDWLVAAGHPVQRIADHDEWVTRFATAMRGLPERQ
RRSSILPLLHAFAEPAPPTFGSRLPTDRFRAAVKAANVVPGNEIPHLDAA
LVTKYADDLRLLDLL
```

>uniprot|B1MCR9|B1MCR9_MYCAB Probable fatty-acid-CoA ligase FadD (SEQ ID NO:76)

```
MTVTNETNPQQEQLSRRIESLRESDPQFRAAQPDPAVAEQVLRPGLHLSE
AIAALMTGYAERPALGERARELVTDQDGRTTLRLLPRFDTTTYGELWSRT
TSVAAAWHHDAAHPVKAGDLVATLGFTSIDYTVLDLAIMILGGVAVPLQT
SAPASQWTTILAEAEPNTLAVSIELIGAAMESVRATPSIKQVVVFDYTPE
VDDQREAFEAASTQLAGTGIAIETLDAVIARGAALPAAPLYAPSAGDDPL
ALLIYTSGSTGAPKGAMHSENIVRRWWIREDVMAGTENLPMIGLNFMPMS
HIMGRGTLTSTLSTGGTGYFAASSDMSTLFEDMELIRPTALALVPRVCDM
VFQRFQTEVDRRLASSDTASAEAVAAEVKADIRDNLFGGRVSAVMVGSAP
LSEELGEFIESCFELNLTDGYGSTEAGMVFRDGIVQRPPVIDYKLVDVPE
LGYFSTDKPHPRGELLLKTDGMFLGYYKRPEVTAGVFDADGFYMTGDIVA
ELAHDNIEIIDRRNNVLKLSQGEFVAVATLEAEYANSPVVHQIYVYGSSE
RSYLLAVVVPTPEAVAAAKGDAAALKTTIADSLQDIAKEIQLQSYEVPRD
FIIEPQPFTQGNGLLTGIAKLARPNLKAHYGPRLEQMYAEIAEQQAAELR
ALHGVDPDKPALETVLKAAQALLGVSSAELAADAHFTDLGGDSLSALSFS
DLLRDIFAVEVPVGVIVSAANDLSGVAKFVDEQRYSGGTRPTAETVHGAG
HTEIRAADLTLDKFIDEATLHAAPSLPKAVGIPHTVLLTGSNGYLGHYLA
LEWLERLDKTEGKLIAIVRGKNAEAAYRRLEEAFDTGDTQLLAHFRSLAD
KHLEVLAGDIGDPNLGLDADTWQRLADTVDVIVHPAALVNHVLPYSQLFG
PNVVGTAEIIKLAITTKIKPVTYLSTVAVAAYVDPTTFDEESDIRLISAV
RPVDELYANGYGNSKWAGEVLLREAHDLCGLPVAVFRSDMILAHSRYTGQ
LNVPDQFTRLILSLIATGIAPGSFYQAHATGERPLAHYDGLPGDFTAEAI
TTLGTQVVDSYETYDCVNPHADGVSLDNFVDWLIEAGYPIARIDNYTEWF
TRFDTAIRSLPEKQKQHSLLPLLHAFEQPSAAENHGVVPAKRFQHAVQAA
GIGPAGQDGTTDIPHLSRRLIVKYAKDLEQLGLL
```

>uniprot|B1MCS0|B1MCS0_MYCAB Probable fatty-acid-CoA ligase FadD (SEQ ID NO:77)
```
MTIDATADNTKEARRQRLGDRIRRLFTDDEQFRAAKPDTAVDTAVAQPGL
RLAQVVATIMNGYADRPALGHRVQELVADAAGRSTLRPLPEFETVTYGEL
WGMARALASTWYHDPAAPVRAGDFVAMLGFTSVDYTAVDLACIHLGAVAV
PLQTSASASNWTAILAESEPAVLAVSAELLDTAMESVLATPSLRHITVFD
YHPGVDVQRESLESAQHRIAEAGLPISVDPIPLAIGHGRALPDAPLFTAE
```

FIG. 17 Cont.

```
EGTDPLALVIYTSGSTGTPKGATYSEKMVAKPWLRADTLSSKAEIPLINL
NFMPMSHVMGRGSLVTALACGGLAYFAASSDMSTLFEDITLTRPTVVTLV
PRVCDMLFQRYRNEVERRTGLDPAADLATLDADVKTDIRENLFGGRVLTI
VCGSAPLSEELAAFIESCLDARITDGYGSTEAGVIVRNGRIQRPPVIDYK
LVDVPELGYFSTDKPHPRGELLVKAESVFGGYFKRPDVTADVFDPDGYYK
TGDIVAELEPDKIQIVDRRNNVIKLSQGEFVAIANLEAEFANSPLVHQIC
VYGSSERSYLLAVVVPTAEAYEQSGGDEDLLKRLIADSLAQVAREAQLQS
YEVPRDFLLETEPFTAANGLLTGIAKLARPKLHEKYGARLEQLYSDIAAA
QALELQALHSAGHEDKPVLDTVQRAVTALLGLSAAEVSPDAHFIDLGGDS
LSALAFSDLLRDIFTVEVPVGDIVSAANDLTAIARIVERHREADGHSVTP
TAESVHGAGHREIRAADLTLDKFIDADTLRAAPALSTFTGTPHTVLLTGA
NGYLGRFLALEWLERLDKTDGKLIAIVRGKNAEAAYRRLEEAFDTGDTQL
LAHFRSLADKHLEVLAGDIGDPNLGLDADTWQRLAETVDVIVHPAALVNH
VLPYSQLFGPNVVGTAEIIKLALTTKIKPITYLSTVAVAISVDPKVFDED
SDIRTISAVRPINDGYANGYGNAKWAGEVLLREAHDLCGLPVAVFRSDMI
LAHSRYTGQLNVPDQFTRLILSLIATGVAPGSFYQAHATGERPLAHYDGL
PADFTASAITALGPIEEFHTYDSVNPHADGISLDNFVDWLIEAGYPIARI
DNYTEWFTRFDTAIRSLPEKQKQHSLLPLLHAYRHPQHPNGAFLPAIRF
SEGVQAHLNADIPHLTRELIAKYAADLKQLGLL

>uniprot|B1MDX4|B1MDX4_MYCAB Putative fatty-acid-CoA ligase (SEQ ID
NO:78)
MTAGAAARVAKLFESDPQFRAAMPDPAVMDSLLAPGLRLSQVLHALLSGY
AERPVMGFRSRESVVDTAIGRTVDRLLPAFETITYGQLLEDISAILAEWQ
HGDIPMGAGDFIATIGFSSPDYVTLDLATLMNGSVSIPLQHNTSVAQLRM
MLEETSPRLVAASADCLDLAVEAAVGLTDLRRVVVFDYRAETDDHREKLA
TARERLHAAGMDVVVEPLAEVIGRGRDLPEPVLYTAGDDQRTALIMYTSG
STGAPKGAMFTEWTVTRFWSSGAAPNRDTPIINVNFLPLNHLAGRVGLLT
AFIPGGTCYFVPESDLSTLFEDWQLARPTHMGVVPRVVDMLFQHYQTRVD
ALMAGGTDVDTADRLAKTELREDVLGGRVVAGMLATAPLSPEMKAFLESS
LDFHLLDLYGLTEVGGVFRDGKISRPPVLDYKLVDVPELGYYTTDKPHPR
GELLVKSATATPGYYKRPDVTAEVFDADGYYRTGDVMAEVAPDQLVYVDR
RNNVIKLAQGEFVAVANLETVYVGAPLVRQIFVYGNSERAYLLAVVVPTE
EALRAHPDPVELKNSIRESLQRTARSNHLHSYELPADFIIETTPFTIESG
MLAAVGKPIRPKMIEHYGDRLEQLYVDLAEARVQELRQLRDTAQQRPVLD
TVTEAAQALLGMSADAVRPDHHFIDLGGDSLSALTFSNLLRDLFDVEVPV
GVITGPAADLRKLAAYIQHEREHSTATAASVHGLDTTVISATELTLDKFI
DAETLHNASQLDVPAGAVATVLLTGANGYLGRFLCLEWLQRLSQTGGQLI
CLVRGDNADQALARLVAAYGDTDRTLLEEFHTLARRHLRVIAADIAQPRF
GVDDATWEQLARDVDKIVHPAALVNHVLPYNQLFGPNVFGTAEVIRLALT
TRIKPVTYLSTMAVAMTVPDFDEDGDIRTVSPTRHIDPGYANGYANSKWA
GEVLLREAHDICGLPVSVFRSDMILTHRRYSGQLNVTDAFTRMLLSLVLT
GIAPRSFYQGDGSGARPRAHYEGLPVDFVTEAITSLGLSSSEGFRSYDVM
NPHDDGISVDTFVDWLMEDGHSIDIIDNYDEWLSRFETALRGLPDEQRRA
SVLPLLDAYRIPGNPRRAAATPNHVFRKAVQENNIGGDGADIPQIDRALI
AKYIADLRAHRLL >uniprot|B1MLD7|B1MLD7_MYCAB Probable fatty-acid-coa ligase FadD (SEQ
ID NO:79)
MTETISTAAVPTTDLEEQVKRRIEQVVSNDPQLAALLPEDSVTEAVNEPD
LPLVEVIRRLLEGYGDRPALGQRAFEFVTGDDGATVIALKPEYTTVSYRE
LWERAEAIAAAWHEQGIRDGDFVAQLGFTSTDFASLDVAGLRLGTVSVPL
QTGASLQQRNAILEETRPAVFAASIEYLDAAVDSVLATPSVRLLSVFDYH
```

FIG. 17 Cont.

```
AEVDSQREALEAVRARLESAGRTIVVEALAEALARGRDLPAAPLPSADPD
ALRLLIYTSGSTGTPKGAMYPQWLVANLWQKKWLTDDVIPSIGVNFMPMS
HLAGRLTLMGTLSGGGTAYYIASSDLSTFFEDIALIRPSEVLFVPRVVEM
VFQRFQAELDRSLAPGESNSEIAERIKVRIREQDFGGRVLSAGSGSAPLS
PEMTEFMESLLQVPLRDGYGSTEAGGVWRDGVLQRPPVTDYKLVDVPELG
YFTTDSPHPRGELRLKSETMFPGYYKRPETTADVFDDEGYYKTGDVVAEL
GPDHLKYLDRVKNVLKLAQGEFVAVSKLEAAYTGSPLVRQIFVYGNSERS
FLLAVVVPTPEVLERYADSPDALKPLIQDSLQQVAKDAELQSYEIPRDFI
VETVPFTVESGLLSDARKLLRPKLKDHYGERLEALYAELAESQNERLRQL
AREAATRPVLETVTDAAAALLGASSSDLAPDVRFIDLGGDSLSALSYSEL
LRDIFEVDVPVGVINSVANDLAAIARHIEAQRTGAATQPTFASVHGKDAT
VITAGELTLDKFLDESLLKAAKDVQPATADVKTVLVTGGNGWLGRWLVLD
WLERLAPNGGKVYALIRGADAEAARARLDAVYESGDPKLSAHYRQLAQQS
LEVIAGDFGDQDLGLSQEVWQKLAKDVDLIVHSGALVNHVLPYSQLFGPN
VAGTAEIIKLAISERLKPVTYLSTVGIADQIPVTEFEEDSDVRVMSAERQ
INDGYANGYGNSKWAGEVLLREAHDLAGLPVRVFRSDMILAHSDYHGQLN
VTDVFTRSIQSLLLTGVAPASFYELDADGNRQRAHYDGVPGDFTAASITA
IGGVNVVDGYRSFDVFNPHHDGVSMDTFVDWLIDAGYKIARIDDYDQWLA
RFELALKGLPEQQRQQSVLPLLKMYEKPQPAIDGSALPTAEFSRAVHEAK
VGDSGEIPHVTKELILKYASDIQLLGLV

>uniprot|B1VMZ4|B1VMZ4_STRGG Putative carboxylic acid reductase (SEQ
ID NO:80)
MAEPLDAATASAHDPGQGLAEALAAVEPGRALAEVMASVLEGHGDRPALG
ERAREPETGRLLPHFDTISYRELWSRVRALAGRWHHDPEYPLGPGDRICT
LGFTSTDYATLDLACIHLGAVPVPLPSNAPLPRLAPVVEESGPTVLAASV
DRLDTAIDVVLASSTIRRLLVFDDGPGATRPGGALAAARQRLSGSPVTVD
TLAGLIDRGRDLPPPPLYIPDPGEDPLALLIYTSGSTGAPKGAMYTQRLL
GTAWYGFSYGAADTPAISVLYLPQSHLAGRYAVMGSLVKGGTGYFTAADD
LSTLFEDIALVRPTELTMVPRLCDMLLQHYRSERDRRADEPGDIEAAVTK
AVREDFLGGRVAKAFVGTAPLSAELTAFVESVLGFHLYTGYGSTEAGGVL
LDTVVQRPPVTDYKLVDVPELGYYATDLPHPRGELLLKSHTLIPGYYRRP
DLTAAIFDADGYYRTGDVFAETGPDRLVYVDRTKDTLKLSQGEFVAVSRL
ETVLLDSPLVQHLYLYGNSERAYLLAVVVPTPDALAGCGGDTEALRPLLM
ESLRSVARRAGLNAYEIPRGILVEPEPFSPENGLFTESHKLLRPRLKERY
GPALELLYDRLADGQDRRLRELRRTGADRPVQETVLRAAQALLGSPGSDL
RPGAHFTDLGGDSLSAVSFSELMKEIFHVDVPVGAIIGPAADLAEVARYI
TAARRPAGAPRPTPASVHGEHRTEVRAGDLAPEKFLDAPTLAAAPALPRP
DGDVRTVLLTGATGYLGRFLCLEWLERLAPSGGRLVCLVRGSDATVAARR
LEAAFDSGDTALLRRYRKAAGKTLDVVAGDIGEPLLGLAEETWRELAGAV
DLIVHPAALVNHLLPYGELFGPNVVGTAEAIRLALTTRLKPVNHVSTVAV
CLGTPAETADENADIRAAVPVRTTGQGYADGYATSKWAGEVLLREAHERY
GLPVAVFRSDMVLAHRTYTGQVNVPDVLTRLLLSLVATGIAPGSFYRTDT
RAHYDGLPVDFTAEAVVALGAPITEGHRTFNVLNPHDDGVSLDTFVDWLI
EAGHPIRRIDDHGAWLTRFTAALRALPEKQRQHSLLPLIGAWAEPGEGAP
GPLLPARRFHAAVRAAGVGPERDIPRVSPDLIRKYVTDLRALGLLAGP >uniprot|B2HE95|B2HE95_MYCMM Fatty-acid-CoA ligase FadD9_1 (SEQ ID
NO:81)
MSITCVDTRAQRSARRIEQLYSTDAQFAAARPSTAVGIAISKSGLGLPQI
IQTVMDGYPQRPALGQRATRVVTDPNTGRSSAQLLAEFETITYRELWNRT
NALTNAFAAEALADRGQRVCVLGFASIDYATIDLALMLLGAVSVPLPTNA
ARAQLCHIVSETQPSLIASSTENLPDAISLVLSHRAPHRVVVFDYRPELD
```

FIG. 17 Cont.

AHREALEAARARLAAIPVTVETLTAIIARGRTVRPAEADCGAQSADAPAL
LIYTSGSTGAPKGVVYTRNRVADFWRTSKAEVEATEQRTAPSITLNFMPM
SHANGRQVLYGTLSNGGTAYFTARSDLSTLFDDLALVRPTELGFPPRIWD
MLLERFGREVDRRLRDGTAEGADPGALKARVAADLRQVLLGGRYALAMMG
SAPISEQMKASVESLLDLDVMEGYGSTEAGTVIINNEVQRPQVIDYKLVD
VAELGYFLTDRPYPRGELLVKTRTLFSGYYRDPEDGAQVFDPDGFYRTGD
IMAQVGPDRLAYLDRRNNVLKLSQGEFVAVSRLEAIFANSPLVRQIFVYA
NGARAYPLAVVVPTQDAQSRHGRAELKAELHTSLHRVAMSAGLAPYEIPR
DFIVETTPFTPQNGLLTAIHKLARPHLTQRYGARLELLYTELADSQTRRL
HRLRQTGGRLPALETIRRAAGALLGTETTEPRPEAHFKDLGGDSVSAVTF
SNLLHDIYGFDVPVGVILGPATDLRALASHVESRRGAGWSGPSFASVHVP
RATSVHAGDLKLAKFLDTKTLAAATSLPAADARARTVLLTGATGFLGRYL
VLEWLRRLRAVGGKLICLVRAASDEQARVRLDTAFDSGDPQLPEHFRQLA
VDRLEVLAGDKSEPGLGLDGPTWQRLADTVDLIVDPATLVNHVLSYRQLF
APNVAGTAELLRLALTTKRKPYAYVSTVSVANQIEPSAFTEDADIREISR
TRTIDDSFANGYTTSKWASEVLLREAHDLCGLPVTVFRCDMILADTSYAG
QLNLADTFTRLMLSVAATGIAPASFYRLGPDGKRQPAHFDGLPVEFIAEA
VATLGARRHDGFQVHHVANPHHDGVGLDEYVDWLVDAGCPIRRIPDYDEW
LSRFETALHALPDRKRRHSLLPLLQNYREPAEPIRGGIAPAPRFRGAVRQ
AKIGRDNDIPHVGPAIIAKYASDLQLLGLA

>uniprot|B2HN69|B2HN69_MYCMM Fatty-acid-CoA ligase FadD9 (SEQ ID
NO:82)
MSPITREERLERRIQDLYANDPQFAAAKPATAITAAIERPGLPLPQIIET
VMTGYADRPALAQRSVEFVTDAGTGHTTLRLLPHFETISYGELWDRISAL
ADVLSTEQTVKPGDRVCLLGFNSVDYATIDMTLARLGAVAVPLQTSAAIT
QLQPIVAETQPTMIAASVDALADATELALSGQTATRVLVFDHHRQVDAHR
AAVESARERLAGSAVVETLAEAIARGDVPRGASAGSAPGTDVSDDSLALL
IYTSGSTGAPKGAMYPRRNVATFWRKRTWFEGGYEPSITLNFMPMSHVMG
RQILYGTLCNGGTAYFVAKSDLSTLFEDLALVRPTELTFVPRVWDMVFDE
FQSEVDRRLVDGADRVALEAQVKAEIRNDVLGGRYTSALTGSAPISDEMK
AWVEELLDMHLVEGYGSTEAGMILIDGAIRRPAVLDYKLVDVPDLGYFLT
DRPHPRGELLVKTDSLFPGYYQRAEVTADVFDADGFYRTGDIMAEVGPEQ
FVYLDRRNNVLKLSQGEFVTVSKLEAVFGDSPLVRQIYIYGNSARAYLLA
VIVPTQEALDAVPVEELKARLGDSLQEVAKAAGLQSYEIPRDFIIETTPW
TLENGLLTGIRKLARPQLKKHYGELLEQIYTDLAHGQADELRSLRQSGAD
APVLVTVCRAAAALLGGSASDVQPDAHFTDLGGDSLSALSFTNLLHEIFD
IEVPVGVIVSPANDLQALADYVEAARKPGSSRPTFASVHGASNGQVTEVH
AGDLSLDKFIDAATLAEAPRLPAANTQVRTVLLTGATGFLGRYLALEWLE
RMDLVDGKLICLVRAKSDTEARARLDKTFDSGDPELLAHYRALAGDHLEV
LAGDKGEADLGLDRQTWQRLADTVDLIVDPAALVNHVLPYSQLFGPNALG
TAELLRLALTSKIKPYSYTSTIGVADQIPPSAFTEDADIRVISATRAVDD
SYANGYSNSKWAGEVLLREAHDLCGLPVAVFRCDMILADTTWAGQLNVPD
MFTRMILSLAATGIAPGSFYELAADGARQRAHYDGLPVEFIAEAISTLGA
QSQDGFHTYHVMNPYDDGIGLDEFVDWLNESGCPIQRIADYGDWLQRFET
ALRALPDRQRHSSLLPLLHNYRQPERPVRGSIAPTDRFRAAVQEAKIGPD
KDIPHVGAPIIVKYVSDLRLLGLL >uniprot|O69484|O69484_MYCLE Putative Acyl-CoA synthetase (SEQ ID
NO:83)
MSTITKQEKQLARRVDDLTANDPQFAAAKPDPAVAAALAQPGLRLPQIIQ
TALDGYAERPALGQRVAEFTKDPKTGRTSMELLPSFETITYRQLGDRVGA
LARAWRHDLLHAGYRVCVLGFNSVDYAIIDMALGVIGAVAVPLQTSAAIT
QLQSIVTETEPSMIATSVNQLPDTVELILSGQAPAKLVVFDYHPEVDEQH
DAVATARARLADSSVVVESLTEVLGRGKTLPATPIPVADDSADPLALLIY
TSGSTGAPKGAMYLQSNVGKMWRRSDGNWFGPTAASITLNFMPMSHVMGR

FIG. 17 Cont.

```
GILYGTLGNGGTAYFAARSDLSTLLEDLKLVRPTELNFVPRIWETLYDES
KRAVDRRLANSGSADRAAIKAEVMDEQRQSLLGGRYIAAMTGSAPTSPEL
KHGVESLLEMHLLEGYGSTEAGMVLFDGEVQRPPVIDYKLVDVPDLGYFS
TDQPYPRGELLLKTQNMFPGYYKRPEVTATVFDSDGYYQTGDIVAEVGPD
RLVYVDRRNNVLKLAQGQFVTVAKLEAAFSNSPLVRQIYIYGNSAHPYLL
AVVVPTEDALATNDIEVLKPLIIDSLQKVAKEADLQSYEVPRDLIVETTP
FSLENGLLTGIRKLAWPKLKQHYGARLEQLYADLVEGQANALHVLKQSVA
NAPVLQTVSRAVGTILGVATTDLPSNAHFTDLGGDSLSALTFGSLLRELF
DIDVPVGVIVSPVNNLVAIADYIERERQGTKRPTFIAIHGRDAGKVHASD
LTLDKFIDVSTLTAAPVLAQPGTEVRTVLLTGATGFLGRYLALKWLERMD
LVEGKVIALVRAKSNEDARARLDKTFDSGDPKLLAHYQELATDHLEVIAG
DKGEVDLELDRQTWRRLADTVDLIVDPAALVNHVLPYSELFGPNTLGTAE
LIRIALTSKQKPYIYVSTIGVGNQIEPAKFTEDSDIRVISPTRNINNNYA
NGYGNSKWAGEVLLREAHDLCGLPVTVFRCDMILADTSYAGQLNVPDMFT
RMMLSLAATGIAPGSFYELDAESNRQRAHYDGLPVEFIAEAISTLGDQSL
HDRDGFTTYHVMNPHDDGIGMDEFVDWLIDAGCPIQRINDYDEWLRRFEI
SLRALPERQRHSSLLPLLHNYQKPEKPLHGSLAPTIRFRTAVQNANIGQD
KDIPHISPAIIAKYVSDLQLLGLV

>uniprot|Q10896|Q10896_MYCTU PROBABLE PEPTIDE SYNTHETASE NRP (PEPTIDE
SYNTHASE) (SEQ ID NO:84)
MSINDQRLTRRVEDLYASDAQFAAASPNEAITQAIDQPGVALPQLIRMVM
EGYADRPALGQRALRFVTDPDSGRTMVELLPRFETITYRELWARAGTLAT
ALSAEPAIRPGDRVCVLGFNSVDYTTIDIALIRLGAVSVPLQTSAPVTGL
RPIVTETEPTMIATSIDNLGDAVEVLAGHAPARLVVFDYHGKVDTHREAV
EAARARLAGSVTIDTLAELIERGRALPATPIADSADDALALLIYTSGSTG
APKGAMYRESQVMSFWRKSSGWFEPSGYPSITLNFMPMSHVGGRQVLYGT
LSNGGTAYFVAKSDLSTLFEDLALVRPTELCFVPRIWDMVFAEFHSEVDR
RLVDGADRAALEAQVKAELRENVLGGRFVMALTGSAPISAEMTAWVESLL
ADVHLVEGYGSTEAGMVLNDGMVRRPAVIDYKLVDVPELGYFGTDQPYPR
GELLVKTQTMFPGYYQRPDVTAEVFDPDGFYRTGDIMAKVGPDQFVYLDR
RNNVLKLSQGEFIAVSKLEAVFGDSPLVRQIFIYGNSARAYPLAVVVPSG
DALSRHGIENLKPVISESLQEVARAAGLQSYEIPRDFIIETTPFTLENGL
LTGIRKLARPQLKKFYGERLERLYTELADSQSNELRELRQSGPDAPVLPT
LCRAAAALLGSTAADVRPDAHFADLGGDSLSALSLANLLHEIFGVDVPVG
VIVSPASDLRALADHIEAARTGVRRPSFASIHGRSATEVHASDLTLDKFI
DAATLAAAPNLPAPSAQVRTVLLTGATGFLGRYLALEWLDRMDLVNGKLI
CLVRARSDEEAQARLDATFDSGDPYLVRHYRELGAGRLEVLAGDKGEADL
GLDRVTWQRLADTVDLIVDPAALVNHVLPYSQLFGPNAAGTAELLRLALT
GKRKPYIYTSTIAVGEQIPPEAFTEDADIRAISPTRRIDDSYANGYANSK
WAGEVLLREAHEQCGLPVTVFRCDMILADTSYTGQLNLPDMFTRLMLSLA
ATGIAPGSFYELDAHGNRQRAHYDGLPVEFVAEAICTLGTHSPDRFVTYH
VMNPYDDGIGLDEFVDWLNSPTSGSGCTIQRIADYGEWLQRFETSLRALP
DRQRHASLLPLLHNYREPAKPICGSIAPTDQFRAAVQEAKIGPDKDIPHL
TAAIIAKYISNLRLLGLL >uniprot|Q5YY80|Q5YY80_NOCFA Putative carboxylic acid reductase (SEQ
ID NO:85)
VESTRATRLRQRIAALYADDAQVRDARPDEAISTALREPGLRLRELVATV
VDGYRDRPALAARSVQPAVDAATGACVARLLPEYTTMSYGELGLRLRAVA
AAWQHDDETRLRPGEFVATLGFTSPDYAVVDLACVWAGAVAVPLQASASV
TQLTAILAETAPAILATGLDTLPHAVDCVLAGATPRALHVFDFDPAIDAQ
RTVYEAACARLAGTGVRVRTLAEVEDRGRALPPAVIDDGPGDDRLALLIY
```

FIG. 17 Cont.

```
TSGSTGTPKGAMYTERLVALMWLGQPQVAALTVNYLPLSHVAGRLALFGL
LARGGTAYFTARADMSTLFEDLALARPTELFVVPRVCEMVLQRFQTERLR
RQADDDRVKADLRLELFGDRLLSVVCGSAPLAPELKAFMESVLDLTLHDG
YGSTEAGGSVVIDTTVRRPPVLDYRLADVPELGYFRTDKPHPRGELLLKT
TTMIPGYYRRPELNAQIFDEDGFYRTGDVVAELAPDRLVYVDRRNNVLKL
AQGEFVTIARLEAIFANSPLVRQIFVYGNSERAYLLAVIVPSRQAMAGDP
ATLKTRIAESLQLIGRDAELEAYEIPRDFLIETEPFTTESGLLSGIGKIL
RPAVEARYRDRLEQLYADLAAAQQDELAALRREAGQRPVLETVTRAAAAI
LGGTASDLSPAAHFTDLGGDSLAALALSNLLREIFAVEVPVGVITGPATD
LRGLAAHIAAERENRTETPLFDRVHPDQILIRATDLALEKFFDAEELAAA
ATAAPPVAEPRVVLLTGANGYLGRFLCLEWLERLDRVDGRLICLVRGADE
AAALARLEAAFDSGDPELVRRFKELAQRRLTVVAGDIGEPGLGLATATWR
RLAAEVEHIVHPAALVNHVLPYRQLFGPNVAGTAEILRLALTERRKPIDF
LSTVAVAAQIPADRFAEDGDIRVISPTRTVDRGYANGYGNSKWAAEVLLR
AAHDRFDLPVAVFRSDMILAHGSFAGQLNIPDVFTRLLLSLLVTGIAPAS
FHAATVTGERPRAHYDGLPADFTAAAITALGARTAGFHTYDVLNPHDDGI
SLDTFVDWLIEAGHPIERIPEHSEWVTRFETALHALPERQRKHSLLPLLH
AYRRPVPALRGSALPAAEFRAAVRAAGITADGDIPHLTRALIEKYVADLR
LHGLL

>uniprot|Q6RKB1|Q6RKB1_9NOCA ATP/NADPH-dependent carboxylic acid
reductase (SEQ ID NO:86)
MAVDSPDERLQRRIAQLFAEDEQVKAARPLEAVSAAVSAPGMRLAQIAAT
VMAGYADRPAAGQRAFELNTDDATGRTSLRLLPRFETITYRELWQRVGEV
AAAWHHDPENPLRAGDFVALLGFTSIDYATLDLADIHLGAVTVPLQASAA
VSQLIAILTETSPRLLASTPEHLDAAVECLLAGTTPERLVVFDYHPEDDD
QRAAFESARRRLADAGSLVIVETLDAVRARGRDLPAAPLFVPDTDDDPLA
LLIYTSGSTGTPKGAMYTNRLAATMWQGNSMLQGNSQRVGINLNYMPMSH
IAGRISLFGVLARGGTAYFAAKSDMSTLFEDIGLVRPTEIFFVPRVCDMV
FQRYQSELDRRSVAGADLDTLDREVKADLRQNYLGGRFLVAVVGSAPLAA
EMKTFMESVLDLPLHDGYGSTEAGASVLLDNQIQRPPVLDYKLVDVPELG
YFRTDRPHPRGELLLKAETTIPGYYKRPEVTAEIFDEDGFYKTGDIVAEL
EHDRLVYVDRRNNVLKLSQGEFVTVAHLEAVFASSPLIRQIFIYGSSERS
YLLAVIVPTDDALRGRDTATLKSALAESIQRIAKDANLQPYEIPRDFLIE
TEPFTIANGLLSGIAKLLRPNLKERYGAQLEQMYTDLATGQADELLALRR
EAADLPVLETVSRAAKAMLGVASADMRPDAHFTDLGGDSLSALSFSNLLH
EIFGVEVPVGVVVSPANELRDLANYIEAERNSGAKRPTFTSVHGGGSEIR
AADLTLDKFIDARTLAAADSIPHAPVPAQTVLLTGANGYLGRFLCLEWLE
RLDKTGGTLICVVRGSDAAAARKRLDSAFDSGDPGLLEHYQQLAARTLEV
LAGDIGDPNLGLDDATWQRLAETVDLIVHPAALVNHVLPYTQLFGPNVVG
TAEIVRLAITARRKPVTYLSTVGVADQVDPAEYQEDSDVREMSAVRVVRE
SYANGYGNSKWAGEVLLREAHDLCGLPVAVFRSDMILAHSRYAGQLNVQD
VFTRLILSLVATGIAPYSFYRTDADGNRQRAHYDGLPADFTAAAITALGI
QATEGFRTYDVLNPYDDGISLDEFVDWLVESGHPIQRITDYSDWFHRFET
AIRALPEKQRQASVLPLLDAYRNPCPAVRGAILPAKEFQAAVQTAKIGPE
QDIPHLSAPLIDKYVSDLELLQLL >uniprot|Q741P9|Q741P9_MYCPA FadD9 (SEQ ID NO:87)
MSTATHDERLDRRVHELIATDPQFAAAQPDPAITAALEQPGLRLPQIIRT
VLDGYADRPALGQRVVEFVTDAKTGRTSAQLLPRFETITYSEVAQRVSAL
GRALSDDAVHPGDRCVLGFNSVDYATIDMALGAIGAVSVPLQTSAAISS
LQPIVAETEPTLIASSVNQLSDAVQLITGAEQAPTRLVVFDYHPQVDDQR
EAVQDAAARLSSTGVAVQTLAELLERGKDLPAVAEPPADEDSLALLIYTS
```

FIG. 17 Cont.

```
GSTGAPKGAMYPQSNVGKMWRRGSKNWFGESAASITLNFMPMSHVMGRSI
LYGTLGNGGTAYFAARSDLSTLLEDLELVRPTELNFVPRIWETLYGEFQR
QVERRLSEAGDAGERRAVEAEVLAEQRQYLLGGRFTFAMTGSAPISPELR
NWVESLLEMHLMDGYGSTEAGMVLFDGEIQRPPVIDYKLVDVPDLGYFST
DRPHPRGELLLRTENMFPGYYKRAETTAGVFDEDGYYRTGDVFAEIAPDR
LVYVDRRNNVLKLAQGEFVTLAKLEAVFGNSPLIRQIYVYGNSAQPYLLA
VVVPTEEALASGDPETLKPKIADSLQQVAKEAGLQSYEVPRDFIIETTPF
SLENGLLTGIRKLAWPKLKQHYGERLEQMYADLAAGQANELAELRRNGAQ
APVLQTVSRAAGAMLGSAASDLSPDAHFTDLGGDSLSALTFGNLLREIFD
VDVPVGVIVSPANDLAAIASYIEAERQGSKRPTFASVHGRDATVVRAADL
TLDKFLDAETLAAAPNLPKPATEVRTVLLTGATGFLGRYLALEWLERMDM
VDGKVIALVRARSDEEARARLDKTFDSGDPKLLAHYQQLAADHLEVIAGD
KGEANLGLGQDVWQRLADTVDVIVDPAALVNHVLPYSELFGPNALGTAEL
IRLALTSKQKPYTYVSTIGVGDQIEPGKFVENADIRQMSATRAINDSYAN
GYGNSKWAGEVLLREAHDLCGLPVAVFRCDMILADTTYAGQLNLPDMFTR
LMLSLVATGIAPGSFYELDADGNRQRAHYDGLPVEFIAAAISTLGSQITD
SDTGFQTYHVMNPYDDGVGLDEYVDWLVDAGYSIERIADYSEWLRRFETS
LRALPDRQRQYSLLPLLHNYRTPEKPINGSIAPTDVFRAAVQEAKIGPDK
DIPHVSPPVIVKYITDLQLLGLL

>uniprot|Q7D6X4|Q7D6X4_MYCTU Substrate--CoA ligase, putative (SEQ ID
NO:88)
MSINDQRLTRRVEDLYASDAQFAAASPNEAITQAIDQPGVALPQLIRMVM
EGYADRPALGQRALRFVTDPDSGRTMVELLPRFETITYRELWARAGTLAT
ALSAEPAIRPGDRVCVLGFNSVDYTTIDIALIRLGAVSVPLQTSAPVTGL
RPIVTETEPTMIATSIDNLGDAVEVLAGHAPARLVVFDYHGKVDTHREAV
EAARARLAGSVTIDTLAELIERGRALPATPIADSADDALALLIYTSGSTG
APKGAMYRESQVMSFWRKSSGWFEPSGYPSITLNFMPMSHVGGRQVLYGT
LSNGGTAYFVAKSDLSTLFEDLALVRPTELCFVPRIWDMVFAEFHSEVDR
RLVDGADRAALEAQVKAELRENVLGGRFVMALTGSAPISAEMTAWVESLL
ADVHLVEGYGSTEAGMVLNDGMVRRPAVIDYKLVDVPELGYFGTDQPYPR
GELLVKTQTMFPGYYQRPDVTAEVFDPDGFYRTGDIMAKVGPDQFVYLDR
RNNVLKLSQGEFIAVSKLEAVFGDSPLVRQIFIYGNSARAYPLAVVVPSG
DALSRHGIENLKPVISESLQEVARAAGLQSYEIPRDFIIETTPFTLENGL
LTGIRKLARPQLKKFYGERLERLYTELADSQSNELRELRQSGPDAPVLPT
LCRAAAALLGSTAADVRPDAHFADLGGDSLSALSLANLLHEIFGVDVPVG
VIVSPASDLRALADHIEAARTGVRRPSFASIHGRSATEVHASDLTLDKFI
DAATLAAAPNLPAPSAQVRTVLLTGATGFLGRYLALEWLDRMDLVNGKLI
CLVRARSDEEAQARLDATFDSGDPYLVRHYRELGAGRLEVLAGDKGEADL
GLDRVTWQRLADTVDLIVDPAALVNHVLPYSQLFGPNAAGTAELLRLALT
GKRKPYIYTSTIAVGEQIRPEAFTEDADIRAISPTRRIDDSYANGYANSK
WAGEVLLREAHEQCGLPVTVFRCDMILADTSYTGQLNLPDMFTRLMLSLA
ATGIAPGSFYELDAHGNRQRAHYDGLPVEFVAEAICTLGTHSPDRFVTYH
VMNPYDDGIGLDEFVDWLNSPTSGSGCTIQRIADYGEWLQRFETSLRALP
DRQRHASLLPLLHNYREPAKPICGSIAPTDQFRAAVQEAKIGPDKDIPHL
TAAIIAKYISNLRLLGLL >uniprot|Q7TY99|Q7TY99_MYCBO PROBABLE FATTY-ACID-CoA LIGASE FADD9
(FATTY-ACID-COA SYNTHETASE) (FATTY-ACID-COA SYNTHASE) (SEQ ID NO:89)
MSINDQRLTRRVEDLYASDAQFAAASPNEAITQAIDQPGVALPQLIRMVM
EGYADRPALGQRALRFVTDPDSGRTMVELLPRFETITYRELWARAGTLAT
ALSAEPAIRPGDRVCVLGFNSVDYTTIDIALIRLGAVSVPLQTSAPVTGL
RPIVTETEPTMIATSIDNLGDAVEVLAGHAPARLVVFDYHGKVDTHREAV
```

FIG. 17 Cont.

```
EAARARLAGSVTIDTLAELIERGRALPATPIADSADDALALLIYTSGSTG
APKGAMYRESQVMSFWRKSSGWFEPSGYPSITLNFMPMSHVGGRQVLYGT
LSNGGTAYYVAKSDLSTLFEDLALVRPTELCFVPRIWDMVFAEFHSEVDR
RLVDGADRAALEAQVKAELRENVLGGRFVMALTGSAPISAEMTAWVESLL
ADVHLVEGYGSTEAGMVLNDGMVRRPAVIDYKLVDVPELGYFGTDQPYPR
GELLVKTQTMFPGYYQRPDVTAEVFDPDGFYRTGDIMAKVGPDQFVYLDR
RNNVLKLSQGEFIAVSKLEAVFGDSPLVRQIFIYGNSARAYPLAVVVPSG
DALSRHGIENLKPVISESLQEVARAAGLQSYEIPRDFIIETTPFTLENGL
LTGIRKLARPQLKKFYGERLERLYTELADSQSNELRELRQSGPDAPVLPT
LCRAAAALLGSTAADVRPDAHFADLGGDSLSALSLANLLHEIFGVDVPVG
VIVSPASDLRALADHIEAARTGVRRPSFASIHGRSATEVHASDLTLDKFI
DAATLAAAPNLPAPSAQVRTVLLTGATGFLGRYLALEWLDRMDLVNGKLI
CLVRARSDEEAQARLDATFDSGDPYLVRHYRELGAGRLEVLAGDKGEADL
GLDRVTWQRLADTVDLIVDPAALVNHVLPYSQLFGPNAAGTAELLRLALT
GKRKPYIYTSTIAVGEQIPPEAFTEDADIRAISPTRRIDDSYANGYANSK
WAGEVLLREAHEQCGLPVTVFRCDMILADTSYTGQLNLPDMFTRLMLSLA
ATGIAPGSFYELDAHGNRQRAHYDGLPVEFVAEAICTLGTHSPDRFVTYH
VMNPYDDGIGLDEFVDWLNSPTSGSGCTIQRIADYGEWLQRFETSLRALP
DRQRHTSLLPLLHNYREPAKPICGSIAPTDQFRAAVQEAKIGPDKDIPHL
TAAIIAKYISNLRLLGLL

>uniprot|Q9CCT4|Q9CCT4_MYCLE Putative acyl-CoA synthetase (SEQ ID NO:90)
VWRQQSISHRKESVMSTITKQEKQLARRVDDLTANDPQFAAAKPDPAVAA
ALAQPGLRLPQIIQTALDGYAERPALGQRVAEFTKDPKTGRTSMELLPSF
ETITYRQLGDRVGALARAWRHDLLHAGYRVCVLGFNSVDYAIIDMALGVI
GAVAVPLQTSAAITQLQSIVTETEPSMIATSVNQLPDTVELILSGQAPAK
LVVFDYHPEVDEQHDAVATARARLADSSVVVESLTEVLGRGKTLPATPIP
VADDSADPLALLIYTSGSTGAPKGAMYLQSNVGKMWRRSDGNWFGPTAAS
ITLNFMPMSHVMGRGILYGTLGNGGTAYFAARSDLSTLLEDLKLVRPTEL
NFVPRIWETLYDESKRAVDRRLANSGSADRAAIKAEVMDEQRQSLLGGRY
IAAMTGSAPTSPELKHGVESLLEMHLLEGYGSTEAGMVLFDGEVQRPPVI
DYKLVDVPDLGYFSTDQPYPRGELLLKTQNMFPGYYKRPEVTATVFDSDG
YYQTGDIVAEVGPDRLVYVDRRNNVLKLAQGQFVTVAKLEAAFSNSPLVR
QIYIYGNSAHPYLLAVVVPTEDALATNDIEVLKPLIIDSLQKVAKEADLQ
SYEVPRDLIVETTPFSLENGLLTGIRKLAWPKLKQHYGARLEQLYADLVE
GQANALHVLKQSVANAPVLQTVSRAVGTILGVATTDLPSNAHFTDLGGDS
LSALTFGSLLRELFDIDVPVGVIVSPVNNLVAIADYIERERQGTKRPTFI
AIHGRDAGKVHASDLTLDKFIDVSTLTAAPVLAQPGTEVRTVLLTGATGF
LGRYLALKWLERMDLVEGKVIALVRAKSNEDARARLDKTFDSGDPKLLAH
YQELATDHLEVIAGDKGEVDLELDRQTWRRLADTVDLIVDPAALVNHVLP
YSELFGPNTLGTAELIRIALTSKQKPYIYVSTIGVGNQIEPAKFTEDSDI
RVISPTRNINNNYANGYGNSKWAGEVLLREAHDLCGLPVTVFRCDMILAD
TSYAGQLNVPDMFTRMMLSLAATGIAPGSFYELDAESNRQRAHYDGLPVE
FIAEAISTLGDQSLHDRDGFTTYHVMNPHDDGIGMDEFVDWLIDAGCPIQ
RINDYDEWLRRFEISLRALPERQRHSSLLPLLHNYQKPEKPLHGSLAPTI
RFRTAVQNANIGQDKDIPHISPAIIAKYVSDLQLLGLV >uniprot|Q54JK0|Q54JK0_DICDI Putative uncharacterized protein (SEQ ID NO:91)
MLKHIKNFLTRKEERKEKEVEKLKDGVSITEVKQSNLVVYSCNGCGSEIWPPKQERYACNECSN
FDLCSECYRKEMILINGTQEEKDKLVSGESNNGIKYEPVRHYDPSPLPHQLTLENETQFQLVYSL
RGNSTFETMEKSFKYFKNRPCLGIRERLGEDNVLSERYKWLTYGEVYEKSLTLAKALTNFIERRD
FISIYMDNCLEWYFTDFASLWAGLIVVPLHHASNSFNLLEILWNSESKCIVCSGESFKNLIELYDQL
```

FIG. 17 Cont.

```
TEQDKLEKPIVLKLIVHKEDLFDQSLVDRLPSGVEFKTFNEMIKIGESLSQAKYEFVPVGPNDLSS
VTYTSGSTGVPKGVMKLDSIFNLLIVNSYVQFPNAVYSYNTLSHSQRLSDWRYIYMGGRVAIYSG
DMNLLFEDLALVRPHSFWAVPRFWNLLFTQFKSDLKQYMFENPQLDERTATLYCYKGIRKLLGD
RINNLVTGGAPTANEVLKFMSDCWKDINISNSYGLTEVSGVCIDGYISDEVEFKIEPVPSFGYYPT
DLPHPRGELVVKSSTMSAGYYKNTQLTSESFEGGWFKTGDVVELIGVRKVKIIDRIKHAFKLANG
EFVTPEPLENNFVSLCINQIFIYGNSLKTFLVAIVKPSQDCLKQLGLQDIPIDQLIENPTLKSKLLSEI
NKISKEKKLANYEIPKIITIDFTEWTIDNKLITGSGKFNRGELYKFYKIKINNMFDIIDKIQQGLRNNNN
NNNNDNINNNDNNNNNESNKDNFENYIKSILNLDGRIEDNNFNLENLSFIQIGGDSLGAVKLSSLL
KEKENIDISPSTILNQNFNLSSLSKLINEKESNQSIVEDFKENFKINWNEEMILDEDIKKSIDQIKNAQ
PSSTPSSSKSTPSQSSSSPPPSLNSNNIGQNAFHMKSIFITGVTGYLGTFLLFNLLEDKSIGIERIY
CLVRNVKNEEEGFKLIERIFEKSCINGMNEKIREKVIPVCGDLSKPFFGVSTETFKMLSLAVDMVIH
NGAIVNMAYPYANMKSTNVTSTRDILRLCTTGRASFKKLVYVSTVGVFFGNGDEKIDESTAPSTF
FLDHGNGYNQTKLISDILVREAASYGLPTMIFRPGTIFSHTQSGFNNQNDSIGLIIKGILGSSSYPTK
KDYSSGDLNLSPVDWVSSSMVSLIKHLPFWCNNTKIYHMVNDNRLSLDLLCQYINKEKQLEEINY
FDWIDAQLNSSNNPLYSIKHLFKKNDRFPIGSQSIKNPKTIKDLESIGELQCQPISDSTVINYVKYLI
SNNLIQTINK

>uniprot|Q2MFQ3|Q2MFQ3_STRRY Putative non-ribosomal peptide synthetase
(SEQ ID NO:92)
MTDTYVSSRPLSKRPQVPGARTPAPGYPRDSRIPELFEAQAAALPQAPAARHGDRTLTYGQLDAHADALADRLAAGG
VRPGDLIGVCGSRSLEALVALLGILKAGCAYVPLDEELPPARLRAMAEDAGISAAVTLPGSTRRVRGLRVSVEVGSL
GRPAPERASGPAPDRATGSAADCAYVAFTSGTTGRPKPVALSHRGVVRLVLSDPGL
TPPGPGDGVLHAYSLSSDASTIEIWGALLTGACLVVADREELLSPTALERLLRAGGVTVAYLTTSVFHLVARTRPEA
LAGLRFVSAGGEAMDPRLANAVLAACPRTTVVNFYGPTENAVVSTAHVLTPLPEDAAHVPLGRPFGASTCHVLRADG
SPARPGEEGELYVGGDGLALGYLGDPQLTAERFVTLPAVEPDGPLYRTGDRAVRHADGLLEYRGRLDRQVKLRGARI
ELDEVETRLRAHPEVGEAAVEVDGHSLTAYVTATVPGRPLPLADLRAYCAKWLPPQAVPALIPLDRFPVTSGGKIDR
SRLKPTAPPPGPEDTAEAARRPDEPEATDGLSGLLSEVWHQVLRVRPTPRDDFFLLGGDSLLASETVTRTLAVLGLD
AALGSTLIRALLAAPTLESFTAAVRGVRGGTGGPAGGQEPAVDFAAETGLGFALPPAEGPAPNPHDPEDVLLTGASG
FVGGFLLHRLLHATAARVHCPVRATSPAHARQRVRTALTRYGLHLDEADWQRVECFPGDLTQPRLGLDHERADALAQ
RLDLIVHNGARVNFLYPYQQLRPANVDGTREVVRIAARRRVPVHFVSTVAVVAGFGTAGVREVDEDLPPAHADGLTM
GYAESKWVAEGVLRQAAAQGLPVAVYRPYEVTGDRTHGACNTETAICSLFKMIADTGVAPDIKLPMDFVPVDHLAES
LVHIATHRPADGRVYHLTNPRPAMLSDVLDRMRAAGFTLRTLPYDAWVGELVRHVAENPTSATAPFVSLCVDRSRTA
DMSVKEMYLKGTFPVLGRRNAEEALAGSGLHCPPVDSALLDRYLEYFFTSGYLTRPAAGPGPESEAERIPEDEPVSG
TEPISGTEPISAAEPISGTEPISAAGPISGTEPIPAAEPISGTAAAARTERSR >gi|215431545|ref|ZP_03429464.1| fatty-acid-CoA ligase fadD9
[Mycobacterium tuberculosis EAS054] (SEQ ID NO:93)
MSINDQRLTRRVEDLYASDAQFAAASPNEAITQAIDQPGVALPQLIRMVMEGYADRPALGQRALRFVTDP
DSGRTMVELLPRFETITYRELWARAGTLATALSAEPAIRPGDRVCVLGFNSVDYTTIDIALIRLGAVSVP
LQTSAPVTGLRPIVTETEPTMIATSIDNLGDAVEVLAGHAPARLVVFDYHGKVDTHREAVEAARARLAGS
VTIDTLAELIERGRALPATPIADSADDALALLTYTSGSTGAPKGAMYRESQVMSFWRKSSGWFEPSGYPS
ITLNFMPMSHVGGRQVLYGTLSNGGTAYFVAKSDLSTLFEDLALVRPTELCFVPRIWDMVFAEFHSEVDR
RLVDGADRAALEAQVKAELRENVLGGRFVMALTGSAPISAEMTAWVESLLADVHLVEGYGSTEAGMVLND
GMVRRPAVIDYKLVDVPELGYFGTDQPYPRGELLVKTQTMFPGYYQRPDVTAEVFDPDGFYRTGDIMAKV
GPDQFVYLDRRNNVLKLSQGEFIAVSKLEAVFGDSPLVRQIFIYGNSARAYPLAVVVPSGDALSRHGIEN
LKPVISESLQEVARAAGLQSYEIPRDFIIETTPFTLENGLLTGIRKLARPQLKKFYGERLERLYTELADS
QSNELRELRQSGPDAPVLPTLCRAAAALLGSTAADVRPDAHFADLGGDSLSALSLANLLHEIFGVDVPVG
VIVSPASDLRALADHIEAARTGVRRPSFASIHGRSATEVHASDLTLDKFIDAATLAAAPNLPAPSAQVRT
VLLTGATGFLGRYLALEWLDRMDLVNGKLICLVRARSDEEAQARLDATFDSGDPYLVRHYRELGAGRLEV
LAGDKGEADLGLDRVTWQRLADTVDLIVDPAALVNHVLPYSQLFGPNAAGTAELLRLALTGKRKPYIYTS
TIAVGEQIPPEAFTEDADIRAISPTRRIDDSYANGYANSKWAGEVLLREAHEQCGLPVTVFRCDMILADT
SYTGQLNLPDMFTRLMLSLAATGIAPGSFYELDAHGNRQRAHYDGLPVEFVAEAICTLGTHSPDRFVTYH
VMNPYDDGIGLDEFVDWLNSPTSGSGCTIQRIADYGEWLQRFETSLRALPDRQRHASLLPLLHNYREPAK
```

FIG. 17 Cont.

PICGSIAPTDQFRAAVQEAKIGPDKDIPHLTAAIIAKYISNLRLLGLL

>gi|218754327|ref|ZP_03533123.1| fatty-acid-CoA ligase fadD9
[Mycobacterium tuberculosis GM 1503] (SEQ ID NO:94)
MVELLPRFETITYRELWARAGTLATALSAEPAIRPGDRVCVLGFNSVDYTTIDIALIRLGAVSVPLQTSA
PVTGLRPIVTETEPTMIATSIDNLGDAVEVLAGHAPARLVVFDYHGKVDTHREAVEAARARLAGSVTIDT
LAELIERGRALPATPIADSADDALALLIYTSGSTGAPKGAMYRESQVMSFWRKSSGWFEPSGYPSITLNF
MPMSHVGGRQVLYGTLSNGGTAYFVAKSDLSTLFEDLALVRPTELCFVPRIWDMVFAEFHSEVDRRLVDG
ADRAALEAQVKAELRENVLGGRFVMALTGSAPISAEMTAWVESLLADVHLVEGYGSTEAGMVLNDGMVRR
PAVIDYKLVDVPELGYFGTDQPYPRGELLVKTQTMFPGYYQRPDVTAEVFDPDGFYRTGDIMAKVGPDQF
VYLDRRNNVLKLSQGEFIAVSKLEAVFGDSPLVRQIFIYGNSARAYPLAVVVPSGDALSRHGIENLKPVI
SESLQEVARAAGLQSYEIPRDFIIETTPFTLENGLLTGIRKLARPQLKKFYGERLERLYTELADSQSNEL
RELRQSGPDAPVLPTLCRAAAALLGSTAADVRPDAHFADLGGDSLSALSLANLLHEIFGVDVPVGVIVSP
ASDLRALADHIEAARTGVRRPSFASIHGRSATEVHASDLTLDKFIDAATLAAAPNLPAPSAQVRTVLLTG
ATGFLGRYLALEWLDRMDLVNGKLICLVRARSDEEAQARLDATFDSGDPYLVRHYRELGAGRLEVLAGDK
GEADLGLDRVTWQRLADTVDLIVDPAALVNHVLPYSQLFGPNAAGTAELLRLALTGKRKPYIYTSTIAVG
EQIPPEAFTEDADIRAISPTRRIDDSYANGYANSKWAGEVLLREAHEQCGLPVTVFRCDMILADTSYTGQ
LNLPDMFTRLMLSLAATGIAPGSFYELDAHGNRQRAHYDGLPVEFVAEAICTLGTHSPDRFVTYHVMNPY
DDGIGLDEFVDWLNSPTSGSGCTIQRIADYGEWLQRFETSLRALPDRQRHASLLPLLHNYREPAKPICGS
IAPTDQFRAAVQEAKIGPDKDIPHLTAAIIAKYISNLRLLGLL >gi|215446840|ref|ZP_03433592.1| fatty-acid-CoA ligase fadD9
[Mycobacterium tuberculosis T85] (SEQ ID NO:95)
DIALIRLGAVSVPLQTSAPVTGLRPIVTETEPTMIATSIDNLGDAVEVLAGHAPARLVVFDYHGKVDTHR
EAVEAARARLAGSVTIDTLAELIERGRALPATPIADSADDALALLIYTSGSTGAPKGAMYRESQVMSFWR
KSSGWFEPSGYPSITLNFMPMSHVGGRQVLYGTLSNGGTAYFVAKSDLSTLFEDLALVRPTELCFVPRIW
DMVFAEFHSEVDRRLVDGADRAALEAQVKAELRENVLGGRFVMALTGSAPISAEMTAWVESLLADVHLVE
GYGSTEAGMVLNDGMVRRPAVIDYKLVDVPELGYFGTDQPYPRGELLVKTQTMFPGYYQRPDVTAEVFDP
DGFYRTGDIMAKVGPDQFVYLDRRNNVLKLSQGEFIAVSKLEAVFGDSPLVRQIFIYGNSARAYPLAVVV
PSGDALSRHGIENLKPVISESLQEVARAAGLQSYEIPRDFIIETTPFTLENGLLTGIRKLARPQLKKFYG
ERLERLYTELADSQSNELRELRQSGPDAPVLPTLCRAAAALLGSTAADVRPDAHFADLGGDSLSALSLAN
LLHEIFGVDVPVGVIVSPASDLRALADHIEAARTGVRRPSFASIHGRSATEVHASDLTLDKFIDAATLAA
APNLPAPSAQVRTVLLTGATGFLGRYLALEWLDRMDLVNGKLICLVRARSDEEAQARLDATFDSGDPYLV
RHYRELGAGRLEVLAGDKGEADLGLDRVTWQRLADTVDLIVDPAALVNHVLPYSQLFGPNAAGTAELLRL
ALTGKRKPYIYTSTIAVGEQIPPEAFTEDADIRAISPTRRIDDSYANGYANSKWAGEVLLREAHEQCGLP
VTVFRCDMILADTSYTGQLNLPDMFTRLMLSLAATGIAPGSFYELDAHGNRQRAHYDGLPVEFVAEAICT
LGTHSPDRFVTYHVMNPYDDGIGLDEFVDWLNSPTSGSGCTIQRIADYGEWLQRFETSLRALPDRQRHAS
LLPLLHNYREPAKPICGSIAPTDQFRAAVQEAKIGPDKDIPHLTAAIIAKYISNLRLLGLL >gi|219558593|ref|ZP_03537669.1| fatty-acid-CoA ligase fadD9
[Mycobacterium tuberculosis T17] (SEQ ID NO:96)
MSINDQRLTRRVEDLYASDAQFAAASPNEAITQAIDQPGVALPQLIRMVMEGYADRPALGQRALRFVTDP
DSGRTMVELLPRFETITYRELWARAGTLATALSAEPAIRPGDRVCVLGFNSVDYTTIDIALIRLGAVSVP
LQTSAPVTGLRPIVTETEPTMIATSIDNLGDAVEVLAGHAPARLVVFDYHGKVDTHREAVEAARARLAGS
VTIDTLAELIERGRALPATPIADSADDALALLIYTSGSTGAPKGAMYRESQVMSFWRKSSGWFEPSGYPS
ITLNFMPMSHVGGRQVLYGTLSNGGTAYFVAKSDLSTLFEDLALVRPTELCFVPRIWDMVFAEFHSEVDR
RLVDGADRAALEAQVKAELRENVLGGRFVMALTGSAPISAEMTAWVESLLADVHLVEGYGSTEAGMVLND
GMVRRPAVIDYKLVDVPELGYFGTDQPYPRGELLVKTQTMFPGYYQRPDVTAEVFDPDGFYRTGDIMAKV
GPDQFVYLDRRNNVLKLSQGEFIAVSKLEAVFGDSPLVRQIFIYGNSARAYPLAVVVPSGDALSRHGIEN
LKPVISESLQEVARAAGLQSYEIPRDFIIETTPFTLENGLLTGIRKLARPQLKKFYGERLERLYTELADS
QSNELRELRQSGPDAPVLPTLCRAAAALLGSTAADVRPDAHFADLGGDSLSALSLANLLHEIFGVDVPVG
VIVSPASDLRALADHIEAARTGVRRPSFASIHGRSATEVHASDLTLDKFIDAATLAAAPNLPAPSAQVRT
VLLTGATGFLGRYLALEWLDRMDLVNGKLICLVRARSDEEAQARLDATFDSGDPYLVRHYRELGAGRLEV

FIG. 17 Cont.

LAGDKGEADLGLDRVTWQRLADTVDLIVDPAALVNHVLPYSQLFGPNAAGTAELLRLALTGKRKPYIYTS
TIAVGEQIPPEAFTEDADIRAISPTRRIDDSYANGYANSKWAGEVLLREAHEQCGLPVTVFRCDMILGRH
QLYRSAQPAGHVTRADAEPG

>gi|254819907|ref|ZP_05224908.1| FadD9 [Mycobacterium intracellulare
ATCC 13950] (SEQ ID NO:97)
MSTAIHDEHLDRRIEELIANDPQFAAARPDPAITAATEAPGLRLPQIIRTVLDGYADRPALAQRVVEFVT
DAKTGRTTAELLPRFETITYGELGERVSALGRAWAGDAVRPGDRVCVLGFNSVDYATIDIALGTIGAVSV
PLQTSAAISSLQPIVAETEPSLIASSVNQLPDAVELILAGDHVPGKLVVFDYQPQVDDQREAVEAAAARL
ADSGVAVEALADVLRRGKDLPAVEPPASDEDSLALLIYTSGSTGAPKGAMYPQSNVGKMWRRGSKNWFGE
SAASITLNFMPMSHVMGRGILYGTLGNGGTAYFAARSDLSTLLEDLELVRPTEMNFVPRIWETLYGEFQR
QVERRLADGDAGPEARETVAAAVLEEQRQYLLGGRFIFAMTGSAPTSPELKAWAESLLQMHLMDGYGSTE
AGMVLFDGEIQRPPVIDYKLVDVPDLGYFSTDRPHPRGELLLRTENMFPGYYKRAETTANVFDEDGYYRT
GDVFAEIAPDRLVYVDRRNNVLKLAQGEFVTLAKLEAVFGNSPLIRQIYVYGNSSQPYLLAVVVPTEEAL
ADNDLESLKPKIADSLQKVAKETGLQSYEVPRDFIIETTPFTLENGLLTGIRKLAWPKLKAHYGDRLEQM
YAELAAGQANELAELRRSGAAAPVAQTVSRAAAALLGATAGDLSADAHFTDLGGDSLSALTFGNLLREIF
DVDVPVGVIVSPANDLAGIAAYIEAERQGSKRPTFAAVHGRGATMVHASDLTLDKFLDEATLAAAPSLPK
PATEVRTVLLTGATGFLGRYLALDWLERMDMVDGKVIALVRARTDEEARARLDKTFDSGDPKLLAHYQRL
AADHLEVIAGDKGEANLGLDPQTWQRLAEEVDVIVDPAALVNHVLPYSELFGPNALGTAELIRIALTSRQ
KPYTYVSTIGVGDQIQPGEFVENADIRQISATREINDGYANGYGNSKWAGEVLLREAHDLCGLPVTVFRC
DMILADTTYAGQLNLPDMFTRLMLSLVATGIAPGSFYELDADGNRQRAHYDGLPVEFIAAAISTLGTQIT
DSDTGFQTYHVMNPYDDGIGLDEYIDWLIEAGYSIERIADYSEWLRRFETSLRALPDRQRQYSLLPLLHN
YQKPEKPINGSMAPTDVFRAAVQEAKIGPDKDIPHVSAPVIVKYITDLELLGLL ygjB (NP_418690) (SEQ ID NO:98)
```
  1 msmiksyaak eaggelevye ydpgelrpqd vevqvdycgi chsdlsmidn ewgfsqyplv
 61 aghevigrvv algsaaqdkg lqvgqrvgig wtarscghcd acisgnqinc eqgavptimn
121 rggfaeklra dwqwviplpe nidiesagpl lcggitvfkp llmhhitats rvgvigiggl
181 ghiaikllha mgcevtafss npakeqevla mgadkvvnsr dpqalkalag qfdliintvn
241 vsldwqpyfe altyggnfht vgavltplsv paftliagdr svsgsatgtp yelrklmrfa
301 arskvaptte lfpmskinda iqhvrdgkar yrvvlkadf
```
yahK (NP_414859) (SEQ ID NO:99)
```
  1 mkikavgays akqplepmdi trrepgpndv kieiaycgvc hsdlhqvrse wagtvypcvp
 61 gheivgrvva vgdqvekyap gdlvgvgciv dsckhceece dglenycdhm tgtynsptpd
121 epghtlggys qqivvheryv lrirhpqeql aavapllcag ittysplrhw qagpgkkvgv
181 vgigglghmg iklahamgah vvafttseak reaakalgad evvnsrnade maahlksfdf
241 ilntvaaphn lddfttllkr dgtmtlvgap atphkspevf nlimkrraia gsmiggipet
301 qemldfcaeh givadiemir adqineayer mlrgdvkyrf vidnrtltd
```
adhP (NP_415995) (SEQ ID NO:100)
```
  1 mkaavvtkdh hvdvtyktlr slkhgeallk meccgvchtd lhvkngdfgd ktgvilgheg
 61 igvvaevgpg vtslkpgdra svawfyegcg hceycnsgne tlcrsvknag ysvdggmaee
121 civvadyavk vpdgldsaaa ssitcagvtt ykavklskir pgqwiaiygl gglgnlalqy
181 aknvfnakvi aidvndeqlk latemgadla inshtedaak ivqektggah aavvtavaka
241 afnsavdavr aggrvvavgl ppesmsldip rlvldgievv gslvgtrqdl teafqfaaeg
301 kvvpkvalrp ladintifte meegkirgrm vidfrh
```
ydjL (NP_416290) (SEQ ID NO:101)
```
  1 mkalarfgka fggykmidvp qpmcgpedvv ieikaaaicg admkhynvds gsdefnsirg
 61 hefagciaqv gekvkdwkvg qrvvsdnsgh vcgvcpaceq gdflccteky nlgldnntwg
121 ggfskyclvp geilkihrha lweipdgvdy edaavldpic nayksiaqqs kflpgqdvvv
181 igtgplglfs vqmarimgav nivvvglqed vavrfpvake lgatavvngs tedvvarcqq
241 icgkdnlglv iecsganial kqaiemlrpn gevvrvgmgf kpldfsindi tawnksiigh
301 maydstswrn airllasgai kvkpmithri glsqwregfd amvdktaikv imtydfde
```

FIG. 17 Cont.

ydjJ (NP_416288) (SEQ ID NO:102)

```
  1 mknskailqv pgtmkiisae ipvpkedevl ikveyvgicg sdvhgfesgp fippkdpnqe
 61 iglghecagt vvavgsrvrk fkpgdrvnie pgvpcghcry clegkynicp dvdfmatqpn
121 yrgalthylc hpesftyklp dnmdtmegal vepaavgmha amladvkpgk kiiilgagci
181 glmtlqackc lgateiavvd vlekrlamae qlgatvving akedtiarcq qftedmgadi
241 vfetagsavt vkqapylvmr ggkimivgtv pgdsainflk inrevtiqtv fryanrypvt
301 ieaissgrfd vksmvthiyd yrdvqqafee svnnkrdiik gvikisd
``` idnD (NP_418688) (SEQ ID NO:103)

```
  1 mqvktqscvv agkktvavte qtidwnnngt lvqitrggic gsdlhyyqeg kvgnfmikap
 61 mvlghevigk vihsdsselh egqtvainps kpcghckyci ehnenqctdm rffgsamyfp
121 hvdggftryk mvetsqcvpy pakadekvma faeplavaih aahqagelqg krvfisgvgp
181 igclivsavk tlgaaeivca dvsprslslg kemgadvlvn pqnddmdhwk aekgyfdvsf
241 evsghpssvn tclevtrarg vmvqvgmgga maefpmmtli gkeislrgsf rftsefntav
301 swlangvinp lpllsaeypf tdleealrfa gdktqaakvq lvf
``` tdh (NP_418073) (SEQ ID NO:104)

```
  1 mkalsklkae egiwmtdvpv pelghndlli kirktaicgt dvhiynwdew sqktipvpmv
 61 vgheyvgevv gigqevkgfk igdrvsgegh itcghcrncr ggrthlcrnt igvgvnrpgc
121 faeylvipaf nafkipdnis ddlaaifdpf gnavhtalsf dlvgedvlvs gagpigimaa
181 avakhvgarn vvitdvneyr lelarkmgit ravnvakenl ndvmaelgmt egfdvglems
241 gappafrtml dtmnhggria mlgippsdms idwtkvifkg lfikgiygre mfetwykmaa
301 liqsgldlsp iithrfsidd fqkgfdamrs gqsgkvilsw d
``` yjjN (NP_418778) (SEQ ID NO:105)

```
  1 mstmnvlicq qpkelvwkqr eipipgdnea likiksvgic gtdihawggn qpffsyprvl
 61 gheicgeivg lgkniadlkn gqqvavipyv acqqcpacks grtnccekis vigvhqdggf
121 seylsvpvan ilpadgidpq aaaliepfai sahavrraai apgeqvlvvg agpiglgaaa
181 iakadgaqvv vadtsparre hvatrlelpl ldpsaedfda qlraqfggsl aqkvidatgn
241 qhamnntvnl irhggtvvfv glfkgelqfs dpefhkkett mmgsrnatpe dfakvgrlma
301 egkitadmml thrypfatla etyerdvinn relikgvitf
``` rspB (NP_416097) (SEQ ID NO:106)

```
  1 mksiliekpn qlaivereip tpsagevrvk vklagicgsd shiyrghnpf akyprvighe
 61 ffgvidavge gvesarvger vavdpvvscg hcypcsigkp nvcttlavlg vhadggfsey
121 avvpaknawk ipeavadqya vmiepftiaa nvtghgqpte ndtvlvygag pigltivqvl
181 kgvynvknvi vadriderle kakesgadwa innsqtplge iftekgikpt liidaachps
241 ilkeavtlas paarivlmgf ssepseviqq gitgkelsif ssrlnankfp ividwlskgl
301 ikpeklitht fdfqhvadai slfeqdqkhc ckvlltfse
``` gatD (NP_416594) (SEQ ID NO:107)

```
  1 mksvvndtdg ivrvaesvip eikhqdevrv kiassglcgs dlprifknga hyypitlghe
 61 fsgyidavgs gvddlhpgda vacvpllpcf tcpeclkgfy sqcakydfig srrdggfaey
121 ivvkrknvfa lptdmpiedg afiepitvgl hafhlaqgce nknviiigag tigllaiqca
181 valgaksvta idisseklal aksfgamqtf nssemsapqm qsvlrelrfn qliletagvp
241 qtvelaveia gphaqlalvg tlhqdlhlts atfgkilrke ltvigswmny sspwpgqewe
301 tasrllterk lslepliahr gsfesfaqav rdiarnampg kvllip
``` yphC (NP_417040) (SEQ ID NO:108)

```
  1 mktmlaaylp gnstvdlrev avptpginqv likmkssgic gsdvhyiyhq hrataaapdk
 61 plyqgfingh epcgqivamg qgcrhfkegd rvlvyhisgc gfcpncrrgf pisctgegka
121 aygwqrdggh aeyllaeekd lillpdalsy edgafiscgv gtayegilrg evsgsdnvlv
181 vglgpvqmma mmlakgrgak riigvdmlpe rlamakqlgv mdhgylatte glpqiiaelt
241 hggadvaldc sgnaagrlla lqstadwgrv vyigetgkve fevsadlmhh qrriigswvt
301 slfhmekcah dltdwklwpr naithrfsle qagdayalma sgkcgkvvin fpd
``` yhdH (NP_417719) (SEQ ID NO:109)

```
  1 mqallleqqd gktlasvqtl desrlpegdv tvdvhwssln ykdalaitgk gkiirnfpmi
 61 pgidfagtvr tsedprfhag qevlltgwgv genhwgglae qarvkgdwlv ampqgldark
121 amiigtagft amlcvmaled agvrpqdgei vvtgasggvg stavallhkl gyqvvavsgr
181 estheylksl gasrvlprde faesrplekq vwagaidtvg dkvlakvlaq mnyggcvaac
241 glaggftlpt tvmpfilrnv rlqgvdsvmt pperraqawq rlvadlpesf ytqaakeisl
```

FIG. 17 Cont.

```
         301 seapnfaeai innqiqgrtl vkvn
ycjQ  (NP_415829)(SEQ ID NO:110)
           1 mkklvatapr vaalveyedr ailanevkir vrfgapkhgt evvdfraasp fidedfngew
          61 qmftprpada prgiefgkfq lgnmvvgdii ecgsdvtdya vgdsvcgygp lsetviinav
         121 nnyklrkmpq gsswknavcy dpaqfamsgv rdanvrvgdf vvvvglgaig qiaiqlakra
         181 gasvvigvdp iahrcdiarr hgadfclnpi gtdvgkeikt ltgkqgadvi ietsgyadal
         241 qsalrglayg gtisyvafak pfaegfnlgr eahfnnakiv fsracsepnp dyprwsrkri
         301 eetcwellmn gylncedlid pvvtfanspe symqyvdqhp eqsikmgvtf
yncB  (NP_415966)(SEQ ID NO:111)
           1 mgqqkqrnrr wvlasrphga pvpenfrlee ddvatpgegq vllrtvylsl dpymrgrmsd
          61 epsysppvdi ggvmvggtvs rvvesnhpdy qsgdwvlgys gwqdydissg ddlvklgdhp
         121 qnpswslgvl gmpgftaymg lldigqpkeg etlvvaaatg pvgatvgqig klkgcrvvgv
         181 aggaekcrha tevlgfdvcl dhhaddfaeq lakacpkgid iyyenvggkv fdavlpllnt
         241 saripvcglv ssynatelpp gpdrlpllma tvlkkrirlq gfiiaqdygh rihefqremg
         301 qwvkedkihy reeitdglen apqtfigllk gknfgkvvir vagdd
qor  (NP_418475)(SEQ ID NO:112)
           1 matriefhkh ggpevlqave ftpadpaene iqvenkaigi nfidtyirsg lypppslpsg
          61 lgteaagivs kvgsgvkhik agdrvvyaqs algayssvhn iiadkaailp aaisfeqaaa
         121 sflkgltvyy llrktyeikp deqflfhaaa ggvgliacqw akalgaklig tvgtaqkaqs
         181 alkagawqvi nyreedlver lkeitggkkv rvvydsvgrd twersldclq rrglmvsfgn
         241 ssgavtgvnl gilnqkgsly vtrpslqgyi ttreelteas nelfsliasg vikvdvaeqq
         301 kyplkdaqra heilesratq gssllip
frmA  (NP_414890)(SEQ ID NO:113)
           1 mksraavafa pgkpleivei dvappkkgev likvthtgvc htdaftlsgd dpegvfpvvl
          61 ghegagvvve vgegvtsvkp gdhviplyta ecgecefcrs gktnlcvavr etqgkglmpd
         121 gttrfsyngq plyhymgcst fseytvvaev slakinpean hehvcllgcg vttgigavhn
         181 takvqpgdsv avfglgaigl avvqgarqak agriiaidtn pkkfdlarrf gatdcinpnd
         241 ydkpikdvll dinkwgidht fecignvnvm raalesahrg wgqsviigva vagqeistrp
         301 fqlvtgrvwk gsafggvkgr sqlpgmveda mkgdidlepf vthtmsldei ndafdlmheg
         361 ksirtviry
ybdR  (NP_415141)(SEQ ID NO:114)
           1 mkaltyhgph hvqvenvpdp gveqaddiil ritataicgs dlhlyrgkip qvkhgdifgh
          61 efmgevvetg kdvknlqkgd rvvipfviac gdcffcrlqq yaacentnag kgaalnkkqi
         121 papaalfgys hlyggvpggq aeyvrvpkgn vgpfkvppll sddkalflsd ilptawqaak
         181 naqiqqgssv avygagpvgl ltiacarllg aeqifvvdhh pyrlhfaadr ygaipinfde
         241 dsdpaqsiie qtaghrgvda vidavgfeak gsttetvltn lklegssgka lrqciaavrr
         301 ggivsvpgvy aqfihgflfg dafdkglsfk mgqthvhawl gellpliekg llkpeeivth
         361 ympfeeaarg yeifekreee crkvilvpga qsaeaaqkav sglvnampgg ti
YggP  (YP_026187)(SEQ ID NO:115)
           1 mktkvaaiyg krdvrlrvfe lpeitdnell vsvisdsvcl stwkaallgs ehkrvpddle
          61 nhpvitghec agvivevgkn ltgkykkgqr fvlqpamglp sgysagysye yfggnatymi
         121 ipeiainlgc vlpyhgsyfa aaslaepmcc iigayhanyh ttqyvyehrm gvkpggnial
         181 lacagpmgig aidyainggi qpsrvvvvdi ddkrlaqvqk llpvelaask gielvyvntk
         241 gmsdpvqmlr altgdagfdd ifvyaavpav vemadellae dgclnffagp tdknfkvpfn
         301 fynvhynsth vvgtsggstd dmkeaialsa tgqlqpsfmv thiggldavp etvlnlpdip
         361 ggkkliyngv tmpltaiadf aekgktdplf kelarlveet hgiwneqaek yllaqfgvdi
         421 geaaq
YiaY  (YP_026233)(SEQ ID NO:116)
Amino acid sequence (SEQ ID NO:130)
           1 maastffips vnvigadslt damnmmadyg ftrtlivtdn mltklgmagd vqkaleerni
          61 fsviydgtqp npttenvaag lkllkenncd svislgggsp hdcakgialv aanggdirdy
         121 egvdrsakpq lpmiaintta gtasemtrfc iitdearhik maivdkhvtp llsvndsslm
         181 igmpksltaa tgmdalthai eayvsiaatp itdacalkav tmiaenlpla vedgsnakar
         241 eamayaqfla gmafnnaslg yvhamahqlg gfynlphgvc navllphvqv fnskvaaarl
         301 rdcaaamgvn vtgkndaega eacinairel akkvdipagl rdlnvkeedf avlatnalkd
         361 acgftnpiqa theeivaiyr aam
FucO  (NP_417279)(SEQ ID NO:117)
           1 mmanrmilne tawfgrgavg altdevkrrg yqkalivtdk tlvqcgvvak vtdkmdaagl
```

FIG. 17 Cont.

```
     61 awaiydgvvp nptitvvkeg lgvfqnsgad yliaigggsp qdtckaigii snnpefadvr
    121 sleglsptnk psvpilaipt tagtaaevti nyvitdeekr rkfvcvdphd ipqvafidad
    181 mmdgmppalk aatgvdalth aiegyitrga waltdalhik aieiiagalr gsvagdkdag
    241 eemalgqyva gmgfsnvglg lvhgmahplg afyntphgva naillphvmr ynadftgeky
    301 rdiarvmgvk vegmsleear naaveavfal nrdvgipphl rdvgvrkedi palaqaaldd
    361 vctggnprea tledivelyh taw
EutG (NP_416948) (SEQ ID NO:118)
      1 mqnelqtalf qafdtlnlqr vktfsvppvt lcgpgsvssc gqqaqtrglk hlfvmadsfl
     61 hqagmtaglt rsltvkgiam tlwpcpvgep citdvcaava qlresgcdgv iafgggsvld
    121 aakavtllvt npdstlaems etsvlqprlp liaipttagt gsettnvtvi idavsgrkqv
    181 lahaslmpdv aildaalteg vpshvtamtg idalthaiea ysalnatpft dslaigaiam
    241 igkslpkavg yghdlaares mllascmagm afssaglglc hamahqpgaa lhiphglana
    301 mllptvmefn rmvcrerfsq igralrtkks ddrdainavs eliaevgigk rlgdvgatsa
    361 hygawaqaal ediclrsnpr tasleqivgl yaaaq
YqhD (NP_417484) (SEQ ID NO:119)
      1 mnnfnlhtpt rilfgkgaia glreqiphda rvlityggggs vkktgvldqv ldalkgmdvl
     61 efggiepnpa yetlmnavkl vreqkvtfll avgggsvldg tkfiaaaany penidpwhil
    121 qtggkeiksa ipmgcvltlp atgsesnaga visrkttgdk qafhsahvqp vfavldpvyt
    181 ytlpprqvan gvvdafvhtv eqyvtkpvda kiqdrfaegi lltliedgpk alkepenydv
    241 ranvmwaatq alngligagv pqdwathmlg heltamhgld haqtlaivlp alwnekrdtk
    301 rakllqyaer vwnitegsdd eridaaiaat rnffeqlgvp thlsdygldg ssipallkkl
    361 eehgmtqlge nhditldvsr riyeaar
AdhE (NP_415757) (SEQ ID NO:120)
      1 mavtnvaeln alververvkkaq reyasftqeq vdkifraaal aaadaripla kmavaesgmg
     61 ivedkviknh faseyiynay kdektcgvls eddtfgtiti aepigiicgi vpttnptsta
    121 ifkslislkt rnaiifsphp rakdatnkaa divlqaaiaa gapkdligwi dqpsvelsna
    181 lmhhpdinli latggpgmvk aayssgkpai gvgagntpvv idetadikra vasvlmsktf
    241 dngvicaseq svvvvdsvyd avrerfathg gyllqgkelk avqdvilkng alnaaivgqp
    301 aykiaelagf svpentkili gevtvvdese pfaheklspt lamyrakdfe davekaeklv
    361 amggightsc lytdqdnqpa rvsyfgqkmk tarilintpa sqggigdlyn fklapsltlg
    421 cgswggnsis envgpkhlin kktvakraen mlwhklpksi yfrrgslpia ldevitdghk
    481 ralivtdrfl fnngyadqit svlkaagvet evffeveadp tlsivrkgae lansfkpdvi
    541 ialgggspmd aakimwvmye hpethfeela lrfmdirkri ykfpkmgvka kmiavtttsg
    601 tgsevtpfav vtddatgqky pladyaltpd maivdanlvm dmpkslcafg gldavthame
    661 ayvsvlasef sdgqalqalk llkeylpasy hegsknpvar ervhsaatia giafanaflg
    721 vchsmahklg sqfhiphgla nallicnvir ynandnptkq tafsqydrpq arrryaeiad
    781 hlglsapgdr taakiekllaw letlkaelg ipksireagv qeadflanvd klsedafddq
    841 ctganprypl iselkqilld tyygrdyveg etaakkeaap akaekkakks a
dkgB (NP_414743) (SEQ ID NO:121)
      1 maipafglgt frlkddvvis svitalelgy raidtaqiyd neaavgqaia esgvprhely
     61 ittkiwienl skdklipslk eslqklrtdy vdltlihwps pndevsveef mqalleakkq
    121 gltreigisn ftiplmekai aavgaeniat nqielspylq nrkvvawakq hgihitsymt
    181 laygkalkde viariaakhn atpaqvilaw amgegysvip sstkrknles nlkaqnlqld
    241 aedkkaiaal dcndrlvspe glapewd
YdjG (NP_416285) (SEQ ID NO:122)
      1 mkkiplgttd itlsrmglgt waigggpawn gdldrqicid tileahrcgi nlidtapgyn
     61 fgnsevivgq alkklpreqv vvetkcgivw erkgslfnkv gdrqlyknls pesireevaa
    121 slqrlgidyi diymthwqsv ppfftpiaet vavlnelkse gkiraigaan vdadhireyl
    181 qygeldiiqa kysildrame nellplcrdn givvqvyspl eqglltgtit rdyvpggara
    241 nkvwfqrenm lkvidmleqw qplcaryqct iptlalawil kqsdlisils gatapeqvre
    301 nvaalninls dadatlmrem aealer
YeaE (NP_416295) (SEQ ID NO:123)
      1 mqqkmiqfsg dvslpavgqg twymgedasq rktevaalra gielgltlid taemyadgga
     61 ekvvgealtg lrekvflvsk vypwnaggqk ainaceaslr rlntdyldly llhwsgsfaf
    121 eetvaamekl iaqgkirrwg vsnldyadmq elwqlpggnq catnqvlyhl gsrgieydll
    181 pwcqqqmpv maysplaqag rlrngllkna vvneiahahn isaaqvllaw vishqgvmai
    241 pkaatiahvq qnaavlevel ssaelamldk aypapkgkta ldmv
dkgA (NP_417485) (SEQ ID NO:124)
      1 manptviklq dgnvmpqlgl gvwqasneev itaiqkalev gyrsidtaaa ykneegvgka
     61 lknasvnree lfittklwnd dhkrpreall dslkklqldy idlylmhwpv paidhyveaw
```

FIG. 17 Cont.

```
        121 kgmielqkeg liksigvcnf qihhlqrlid etgvtpvinq ielhplmqqr qlhawnathk
        181 iqteswspla qggkgvfdqk virdladkyg ktpaqivirw hldsglvvip ksvtpsriae
        241 nfdvwdfrld kdelgeiakl dqgkrlgpdp dqfgg
YajO (NP_414953) (SEQ ID NO:125)
          1 mqynplgktd lrvsrlclgc mtfgepdrgn hawtlpeess rpiikraleg ginffdtans
         61 ysdgsseeiv gralrdfarr edvvvatkvf hrvgdlpegl sraqilrsid dslrrlgmdy
        121 vdilqihrwd yntpieetle alndvvkagk aryigassmh asqfaqalel qkqhgwaqfv
        181 smqdhynliy reeeremlpl cyqegvavip wsplargrlt rpwgettarl vsdevgknly
        241 kesdendaqi aerltgvsee lgatraqval awllskpgia apiigtsree qldellnavd
        301 itlkpeqiae letpykphpv vgfk
YghZ (NP_417474) (SEQ ID NO:126)
          1 mvwlanpery gqmqyrycgk sglrlpalsl glwhnfghvn alesqrailr kafdlgithf
         61 dlannygppp gsaeenfgrl lredfaayrd eliistkagy dmwpgpygsg gsrkyllasl
        121 dqslkrmgle yvdifyshrv dentpmeeta salahavqsg kalyvgissy spertqkmve
        181 llrewkipll ihqpsynlln rwvdksglld tlqnngvgci aftplaqgll tgkylngipq
        241 dsrmhregnk vrgltpkmlt eanlnslrll nemaqqrgqs maqmalswll kddrvtsvli
        301 gasraeqlee nvqalnnltf stkelaqidq hiadgelnlw qassdk
Tas (NP_417311) (SEQ ID NO:127)
          1 mqyhriphss levstlglgt mtfgeqnsea dahaqldyav aqginlidva emypvpprpe
         61 tqgltetyvg nwlakhgsre kliiaskvsg psrnndkgir pdqaldrkni realhdslkr
        121 lqtdyldlyq vhwpqrptnc fgklgyswtd sapavslldt ldalaeyqra gkiryigvsn
        181 etafgwmryl hladkhdlpr ivtiqnpysl lnrsfevgla evsqyegvel layclgfgt
        241 ltgkylngak pagarntlfs rftrysgeqt qkavaayvdi arrhgldpaq malafvrrqp
        301 fvastllgat tmdqlktnie slhlelsedv laeieavhqv ytypap
YdhF (YP_025305) (SEQ ID NO:128)
          1 mssntftlgt ksvnrlgyga mqlagpgvfg pprdrhvait vlrealalgv nhidtsdfyg
         61 phvtnqiire alypysddlt ivtkigarrg edaswlpafs paelqkavhd nlrnlgldvl
        121 dvvnlrvmmg dghgpaegsi easltvlaem qqqglvkhig lsnvtptqva earkiaeivc
        181 vqneyniahr addamidala hdgiayvpff plggftplqs stlsdvaasl gatpmqvala
        241 wllqrspnil lipgtssvah lrenmaaekl hlseevlstl dgisre
ybbO (NP_415026) (SEQ ID NO:129)
          1 mthkateilt gkvmqksvli tgcssgigle salelkrqgf hvlagcrkpd dvermnsmgf
         61 tgvlidldsp esvdraadev ialtdnclyg ifnnagfgmy gplstisraq meqqfsanff
        121 gahqltmrll pamlphgegr ivmtssvmgl istpgrgaya askyaleaws dalrmelrhs
        181 gikvsliepg pirtrftdnv nqtqsdkpve npgiaarftl gpeavvdkvr hafisekpkm
        241 rypvtlvtwa vmvlkrllpg rvmdkilqg
yohF (NP_416641) (SEQ ID NO:130)
          1 maqvaiitas dsgigkecal llaqqgfdig itwhsdeega kdtarevvsh gvraeivqld
         61 lgnlpegala lekliqrlgr idvlvnnaga mtkapfldma fdewrkiftv dvdgaflcsq
        121 iaarqmvkqg qggriinits vhehtplpda saytaakhal ggltkamale lvrhkilvna
        181 vapgaiatpm ngmddsdvkp daepsiplrr fgatheiasl vvwlcsegan yttgqslivd
        241 ggfmlanpqf npe
YciK (NP_415787) (SEQ ID NO:131)
          1 mhyqpkqdll ndriilvtga sdgigreaam tyarygatvi llgrneeklr qvashineet
         61 grqpqwfild lltctsencq qlaqriavny prldgvlhna gllgdvcpms eqnpqvwqdv
        121 mqvnvnatfm ltqallplll ksdagslvft sssvgrqgra nwgayaaskf ategmmqvla
        181 deyqqrlrvn cinpggtrta mrasafpted pqklktpadi mplylwlmgd dsrrktgmtf
        241 daqpgrkpgi sq
YgfF (NP_417378) (SEQ ID NO:132)
          1 maialvtggs rgigratall laqegytvav nyqqnlhaaq evmnlitqag gkafvlqadi
         61 sdenqvvamf taidqhdepl aalvnnagil ftqctvenlt aerinrvlst nvtgyflccr
        121 eavkrmalkn ggsggaivnv ssvasrlgsp geyvdyaask gaidtlttgl slevaaqgir
        181 vncvrpgfiy temhasggep grvdrvksni pmqrggqaee vaqaivwlls dkasyvtgsf
        241 idlaggk
YghA (NP_417476) (SEQ ID NO:133)
          1 mgaftgktvl ilggsrgiga aivrrfvtdg anvrftyags kdaakrlaqe tgatavftds
         61 adrdavidvv rksgaldilv vnagigvfge alelnaddid rlfkinihap yhasveaarq
        121 mpeggrilii gsvngdrmpv agmaayaask salqgmargl ardfgprgit invvqpgpid
        181 tdanpangpm rdmlhslmai krhgqpeeva gmvawlagpe asfvtgamht idgafga
YdfG (NP_416057) (SEQ ID NO:134)
```

FIG. 17 Cont.

```
  1 mivlvtgata qfgecitrrf iqqghkviat grrqerlqel kdelgdnlyi aqldvrnraa
 61 ieemlaslpa ewcnidilvn naglalgmep ahkasvedwe tmidtnnkgl vymtravlpg
121 mvernhghii nigstagswp yaggnvygat kafvrqfsln lrtdlhgtav rvtdiepglv
181 ggtefsnvrf kgddgkaekt yqntvaltpe dvseavwwvs tlpahvnint lemmpvtqsy
241 aglnvhrq
```
__YgcW (NP_417254) (SEQ ID NO:135)__
```
  1 msieslnafs mdffslkgkt aivtggnsgl gqafamalak aganifipsf vkdngetkem
 61 iekqgvevdf mqvgitaega pqkiiaacce rfgtvdilvn nagicklnkv ldfgradwdp
121 midvnltaaf elsyeaakim ipqksgkiin icslfsylgg qwspaysatk halagftkay
181 cdelgqyniq vngiapgyya tditlatrsn petnqrvldh ipanrwgdtq dlmgaavfla
241 spasnyvngh llvvdggylv r
```
__UcpA(NP_416921) (SEQ ID NO:136)__
```
  1 mgkltgktal itgalqgige giartfarhg anlillldisp eiekladelc grghrctavv
 61 advrdpasva aaikrakeke gridilvnna gvcrlgsfld msdddrdfhi dinikgvwnv
121 tkavlpemia rkdgrivmms svtgdmvadp getayaltka aivgltksla veyaqsgirv
181 naicpgyvrt pmaesiarqs npedpesvlt emakaipmrr ladplevgel aaflasdess
241 yltgtqnvid ggstlpetvs vgi
```
__EntA (NP_415128) (SEQ ID NO:137)__
```
  1 mdfsgknvwv tgagkgigya talafveaga kvtgfdqaft qeqypfatev mdvadaaqva
 61 qvcqrllaet erldalvnaa gilrmgatdq lskedwqqtf avnvggafnl fqqtmnqfrr
121 qrggaivtva sdaahtprig msaygaskaa lkslalsvgl elagsgvrcn vvspgstdtd
181 mqrtlwvsdd aeeqrirgfg eqfklgiplg kiarpqeian tilflasdla shitlqdivv
241 dggstlga
```
__FolM (NP_416123) (SEQ ID NO:138)__
```
  1 mgktqplpil itgggrrigl alawhfinqk qpvivsyrth ypaidglina gaqciqadfs
 61 tndgvmafad evlksthglr ailhnasawm aekpgaplad vlacmmqihv ntpyllnhal
121 erllrghgha asdiihftdy vvergsdkhi ayaaskaald nmtrsfarkl apevkvnsia
181 pslilfnehd daeyrqqaln kslmktapge kevidlvdyl ltscfvtgrs fpldggrhlr
```
__HdhA ( NP_416136) (SEQ ID NO:139)__
```
  1 mfnsdnlrld gkcaiitgag agigkeiait fatagasvvv sdinadaanh vvdeiqqlgg
 61 qafacrcdit seqelsalad faisklgkvd ilvnnagggg pkpfdmpmad frrayelnvf
121 sffhlsqlva pemeknggv iltitsmaae nkninmtsya sskaaashlv rnmafdlgek
181 nirvngiapg ailtdalksv itpeieqkml qhtpirrlgq pqdianaalf lcspaaswvs
241 gqiltvsggg vqeln
```
__HcaB (NP_417036) (SEQ ID NO:140)__
```
  1 msdlhnesif itgggsglgl alverfieeg aqvatlelsa akvaslrqrf gehilavegn
 61 vtcyadyqra vdqiltrsgk ldcfignagi wdhnaslvnt paetletgfh elfnvnvlgy
121 llgakacapa liasegsmif tlsnaawypg gggplytask haatglirql ayelapkvrv
181 ngvgpcgmas dlrgpqalgq setsimqslt pekiaailpl qffpqpadft gpyvmltsrr
241 nnralsgvmi nadaglairg irhvaagldl
```
__SrlD (NP_417185) (SEQ ID NO:141)__
```
  1 mnqvavvigg gqtlgaflch glaaegyrva vvdiqsdkaa nvaqeinaey gesmaygfga
 61 datseqsvla lsrgvdeifg rvdllvysag iakaafisdf qlgdfdrslq vnlvgyflca
121 refsrlmird giqgriiqin sksgkvgskh nsgysaakfg qvgltqslal dlaeygitvh
181 slmlgnllks pmfqsllpqy atklgikpdq veqyyidkvp lkrgcdyqdv lnmllfyasp
241 kasyctgqsi nvtggqvmf
```
__KduD (NP_417319) (SEQ ID NO:142)__
```
  1 milsafsleg kvavvtgcdt glgqgmalgl aqagcdivgi niveptetie qvtalgrrfl
 61 sltadlrkid gipalldrav aefghidilv nnaglirred alefsekdwd dvmnlniksv
121 ffmsqaaakh fiaqgnggki iniasmlsfq ggirvpsyta sksgvmgvtr lmanewakhn
181 invnaiapgy matnntqqlr adeqrsaeil dripagrwgl psdlmgpivf lassasdyvn
241 gytiavdggw lar
```
__IdnO (NP_418687) (SEQ ID NO:143)__
```
  1 mndlfslagk nilitgsaqg igflllatglg kygaqiiind itaeraelav eklhqegiqa
 61 vaapfnvthk heidaavehi ekdigpidvl vnnagiqrrh pftefpeqew ndviavnqta
121 vflvsqavtr hmverkagkv inicsmqsel grdtitpyaa skgavkmltr gmcvelarhn
181 iqvngiapgy fktemtkalv edeaftawlc krtpaarwgd pqeligaavf lsskasdfvn
241 ghllfvdggm lvav
```
__FabG (NP_415611) (SEQ ID NO:144)__
```
  1 mnfegkialv tgasrgigra iaetlaarga kvigtatsen gaqaisdylg angkglmlnv
```

FIG. 17 Cont.

```
     61 tdpasiesvl ekiraefgev dilvnnagit rdnllmrmkd eewndiietn lssvfrlska
    121 vmrammkkrh griitigsvv gtmgnggqan yaaakaglig fskslareva srgitvnvva
    181 pgfietdmtr alsddqragi laqvpagrlg gaqeianava flasdeaayi tgetlhvngg
    241 mymv
FabI (NP_415804)(SEQ ID NO:145)
      1 mgflsgkril vtgvasklsi aygiaqamhr egaelaftyq ndklkgrvee faaqlgsdiv
     61 lqcdvaedas idtmfaelgk vwpkfdgfvh sigfapgdql dgdyvnavtr egfkiahdis
    121 sysfvamaka crsmlnpgsa lltlsylqae raipnynvmg lakasleanv rymanamgpe
    181 gvrvnaisag pirtlaasgi kdfrkmlahc eavtpirrtv tiedvgnsaa flcsdlsagi
    241 sgevvhvdgg fsiaamnele lk
YdjA (NP_416279)(SEQ ID NO:146)
      1 mdalellinr rsasrlaepa ptgeqlqnil ragmrapdhk smqpwhffvi egegrerfsa
     61 vleqgaiaag sddkaidkar napfraplii tvvakceenh kvprweqems agcavmamqm
    121 aavaqgfggi wrsgaltesp vvreafgcre qdkivgflyl gtpqlkasts invpdptpfv
    181 tyf)
AlrA enzyme from Acinetobacter sp. ADP1 (CAG70248.1)(SEQ ID NO:147)
      1 mttnvihaya amqagealvp ysfdagelqp hqvevkveyc glchsdvsvl nnewhssvyp
     61 vvaghevigt itqlgseakg lkigqrvgig wtaescqacd qcisgqqvlc tgentatiig
    121 haggfadkvr agwqwviplp deldptsagp llcggitvfd pilkhqiqai hhvavigigg
    181 lghmaikllk awgceitafs snpnktdelk amgadhvvns rddaeiksqq gkfdlllstv
    241 nvplnwnayl ntlapngtfh flgvvmepip vpvgallgga ksltasptgs paalrkllef
    301 aarkniapqi emypmselne aierlhsgqa ryrivlkadf
```

*Synechococcus elongatus* PCC7942 Synpcc7942_1594 (YP_400611) amino acid (SEQ ID NO:148)

```
      1 mfglighlts leqardvsrr mgydeyadqg lefwssappq ivdeitvtsa tgkvihgryi
     61 escflpemla arrfktatrk vlnamshaqk hgidisalgg ftsiifenfd laslrqvrdt
    121 tleferfttg nthtayvicr qveaaaktlg iditqatvav vgatgdigsa vcrwldlklg
    181 vgdliltarn qerldnlqae lgrgkilple aalpeadfiv wvasmpqgvv idpatlkqpc
    241 vlidggypkn lgskvqgegi yvlnggvveh cfdidwqims aaemarperq mfacfaeaml
    301 lefegwhtnf swgrnqitie kmeaigeasv rhgfqplala i
```

*Synechocystis* sp. PCC6803 sll0209 (NP_442146) amino acid (SEQ ID NO:149)

```
      1 mfglighlts lehaqavaed lgypeyanqg ldfwcsappq vvdnfqvksv tgqviegkyv
     61 escflpemlt qrrikaairk ilnamalaqk vglditalgg fssivfeefn lkqnnqvrnv
    121 eldfqrfttg nthtayvicr qvesgakqlg idlsqatvav cgatgdigsa vcrwldskhq
    181 vkellliarn rqrlenlqee lgrgkimdle talpqadiiv wvasmpkgve iagemlkkpc
    241 livdggypkn ldtrvkadgv hilkggiveh slditweimk ivemdipsrq mfacfaeail
    301 lefegwrtnf swgrnqisvn kmeaigeasv khgfcplval
```

*Cyanothece* sp. ATCC51142 cce_1430 (YP_001802846) amino acid (SEQ ID NO:150)

```
      1 mfglighlts lehahsvada fgygpyatqg ldlwcsappq fvehfhvtsi tgqtiegkyi
     61 esaflpemli krrikaairk ilnamafaqk nnlnitalgg fssiifeefn lkenrqvrnv
    121 slefdrfttg nthtayiicr qveqasaklg idlsqatvai cgatgdigsa vcrwldrktd
    181 tqelfliarn kerlqrlqde lgrgkimgle ealpeadiiv wvasmpkgve inaetlkkpc
    241 liidggypkn ldtkikhpdv hilkggiveh sldidwkime tvnmdvpsrq mfacfaeail
    301 lefeqwhtnf swgrnqitvt kmeqigeasv khglqpllsw
```

*Prochlorococcus marinus* subsp. pastoris str. CCMP1986 PMM0533 (NP_892651) amino acid (SEQ ID NO:151)

```
      1 mfglighsts fedakrkasl lgfdhiadgd ldvwctappq lvenvevksa igisiegsyi
     61 dscfvpemls rfktarrkvl namelaqkkg initalggft siifenfnll qhkqirntsl
    121 ewerfttgnt htawvicrql emnapkigid lksatvavvg atgdigsavc rwlinktgig
```

FIG. 17 Cont.

```
    181 elllvarqke pldslqkeld ggtiknldea lpeadivvwv asmpktmeid annlkqpclm
    241 idggypknld ekfqgnnihv vkggivrffn digwnmmela emqnpqremf acfaeamile
    301 fekchtnfsw grnnislekm efigaasvkh gfsaigldkh pkvlav
```

*Gloeobacter violaceus* PCC7421 NP_96091 (gll3145) amino acid (SEQ ID NO:152)

```
      1 mfglighltn lshaqrvard lgydeyashd lefwcmappq avdeititsv tgqvihgqyv
     61 escflpemla qgrfktamrk ilnamalvqk rgiditalgg fssiifenfs ldkllnvrdi
    121 tldiqrfttg nthtayilcq qveqgavryg idpakatvav vgatgdigsa vcrwltdraq
    181 ihelllvard aerldrlqqe lgtgrilpve ealpkadivv wvasmnqgma idpaglrtpc
    241 llidggypkn magtlqrpgi hildqgmveh sldidwqims flnvpnparq ffacfaesml
    301 lefeglhfnf swgrnhitve kmaqigslsk khgfrpllep sqrsgelvhg
```

*Nostoc punctiforme* PCC73102 ZP_00108837 (Npun02004176) amino acid (SEQ ID NO:153)

```
      1 mfglighlts lehaqavaqe lgypeyadqg ldfwcsappq ivdsiivtsv tgqqiegryv
     61 escflpemla srrikaatrk ilnamahaqk hginitalgg fssiifenfk leqfsqvrni
    121 kleferfttg nthtayiick qveeaskqlg inlsnatvav cgatgdigsa vtrwldartd
    181 vqellliard qerlkelqge lgrgkimglt ealpqadvvv wvasmprgve idpttlkqpc
    241 llidggypkn latkiqypgv hvlnqgiveh sldidwkimk ivnmdvparq lfacfaesml
    301 lefeklytnf swgrnqitvd kmeqigrvsv khgfrpllv
```

*Anabaena variabilis* ATCC29413 YP_323044 (Ava_2534) amino acid (SEQ ID NO:154)

```
      1 mfglighlts lehaqavaqe lgypeyadqg ldfwcsappq ivdhikvtsi tgeiiegryv
     61 escflpemla srrikaatrk vlnamahaqk hgiditalgg fssiifenfk leqfsqvrnv
    121 tleferfttg nthtayiicr qveqasqqlg ielsqatvai cgatgdigsa vtrwldaktd
    181 vkellliarn qerlqelqse lgrgkimsld ealpqadivv wvasmpkgve inpqvlkqpc
    241 llidggypkn lgtkvqypgv yvlnggiveh sldidwkimk ivnmdvparq lfacfaesml
    301 lefeklytnf swgrnqitvd kmeqigqasv khgfrpllv
```

*Synechococcus elongatus* PCC6301 YP_170761 (syc0051_d) amino acid (SEQ ID NO:155)

```
      1 mfglighlts leqardvsrr mgydeyadqg lefwssappq ivdeitvtsa tgkvihgryi
     61 escflpemla arrfktatrk vlnamshaqk hgidisalgg ftsiifenfd laslrqvrdt
    121 tleferfttg nthtayvicr qveaaaktlg iditqatvav vgatgdigsa vcrwldlklg
    181 vgdliltarn qerldnlqae lgrgkilple aalpeadfiv wvasmpqgvv idpatlkqpc
    241 vlidggypkn lgskvqgegi yvlnggvveh cfdidwqims aaemarperq mfacfaeaml
    301 lefegwhtnf swgrnqitie kmeaigeasv rhgfqplala
```

*Nostoc* sp. PCC 7120 alr5284 (NP_489324) amino acid (SEQ ID NO:156)

```
      1 mfglighlts lehaqavaqe lgypeyadqg ldfwcsappq ivdhikvtsi tgeiiegryv
     61 escflpemla srrikaatrk vlnamahaqk ngiditalgg fssiifenfk leqfsqvrnv
    121 tleferfttg nthtayiicr qveqasqqlg ielsqatvai cgatgdigsa vtrwldaktd
    181 vkellliarn qerlqelqse lgrgkimsld ealpqadivv wvasmpkgve inpqvlkqpc
    241 llidggypkn lgtkvqypgv yvlnggiveh sldidwkimk ivnmdvparq lfacfaesml
    301 lefeklytnf swgrnqitvd kmeqigqasv khgfrpllv
``` pY75 Vector (SEQ ID NO:48)

```
ggccgcaggg cggatccccc gggctgcagg aattcgatat caagcttatc gataccgtcg
acctcgaggg ggggcccggt acccaattcg ccctatagtg agtcgtatta cgcgcgctca
ctggccgtcg ttttacaacg tcgtgactgg gaaaaccctg gcgttaccca acttaatcgc
cttgcagcac atccccttt cgccagctgg cgtaatagcg aagaggcccg caccgatcgc
ccttcccaac agttgcgcag cctgaatggc gaatggcgcg acgcgcctg tagcggcgca
```

FIG. 17 Cont.

```
ttaagcgcgg cgggtgtggt ggttacgcgc agcgtgaccg ctacacttgc cagcgcccta
gcgcccgctc cttcgcttt cttccttcc ttctcgcca cgttcgccgg cttccccgt
caagctctaa atcgggggct ccctttaggg ttccgattta gtgctttacg gcacctcgac
cccaaaaaac ttgattaggg tgatggttca cgtagtgggc catcgccctg atagacggtt
tttcgccctt tgacgttgga gtccacgttc tttaatagtg gactcttgtt ccaaactgga
acaacactca accctatctc ggtctattct tttgatttat aagggatttt gccgatttcg
gcctattggt taaaaatga gctgatttaa caaaattta acgcgaattt taacaaaata
ttaacgttta caattcctg atgcggtatt ttctccttac gcatctgtgc ggtatttcac
accgcatatc gacggtcgag gagaacttct agtatatcca catacctaat attattgcct
tattaaaaat ggaatcccaa caattacatc aaaatccaca ttctcttcaa aatcaattgt
cctgtacttc cttgttcatg tgtgttcaaa acgttatat ttataggata attatactct
atttctcaac aagtaattgg ttgtttggcc gagcggtcta aggcgcctga ttcaagaaat
atcttgaccg cagttaactg tgggaatact caggtatcgt aagatgcaag agttcgaatc
tcttagcaac cattattttt ttcctcaaca taacgagaac acacaggggc gctatcgcac
agaatcaaat tcgatgactg gaaattttt gttaatttca gaggtcgcct gacgcatata
cctttttcaa ctgaaaaatt gggagaaaaa ggaaaggtga gaggccggaa ccggctttc
atatagaata gagaagcgtt catgactaaa tgcttgcatc acaatacttg aagttgacaa
tattatttaa ggacctattg ttttttccaa taggtggtta gcaatcgtct tactttctaa
cttttcttac cttttacatt tcagcaatat atatatat ttcaaggata taccattcta
atgtctgccc ctatgtctgc ccctaagaag atcgtcgttt gccaggtga ccacgttggt
caagaaatca cagccgaagc cattaaggtt cttaaagcta tttctgatgt tcgttccaat
gtcaagttcg atttcgaaaa tcatttaatt ggtggtgctg ctatcgatgc tacaggtgtc
ccacttccag atgaggcgct ggaagcctcc aagaaggttg atgccgtttt gttaggtgct
gtggctggtc ctaaatgggg taccggtagt gttagacctg aacaaggttt actaaaaatc
cgtaaagaac ttcaattgta cgccaactta agaccatgta actttgcatc cgactctctt
ttagacttat ctccaatcaa gccacaattt gctaaggta ctgacttcgt tgttgtcaga
gaattagtgg gaggtattta ctttggtaag agaaaggaag acgatggtga tggtgtcgct
tgggatagtg aacaatacac cgttccagaa gtgcaaagaa tcacaagaat ggccgctttc
atggccctac aacatgagcc accattgcct atttggtcct tggataaagc taatcttttg
gcctcttcaa gattatggag aaaaactgtg gaggaaacca tcaagaacga attccctaca
ttgaaggttc aacatcaatt gattgattct gccgccatga tcctagttaa gaacccaacc
cacctaaatg gtattataat caccagcaac atgtttggtg atatcatctc cgatgaagcc
tccgttatcc caggttcctt gggtttgttg ccatctgcgt ccttggcctc tttgccagac
aagaacaccg catttggttt gtacgaacca tgccacggtt ctgctccaga tttgccaaag
aataaggttg accctatcgc cactatcttg tctgctgcaa tgatgttgaa attgtcattg
aacttgcctg aagaaggtaa ggccattgaa gatgcagtta aaaaggtttt ggatgcaggt
atcagaactg gtgatttagg tggttccaac agtaccaccg aagtcggtga tgctgtcgcc
gaagaagtta agaaaatcct tgcttaaaaa gattctcttt tttatgata tttgtacata
aactttataa atgaaattca taatagaaac gacacgaaat tacaaaatgg aatatgttca
tagggtagac gaaactatat acgcaatcta catacattta tcaagaagga gaaaaggag
gatagtaaag gaatacaggt aagcaaattg atactaatgg ctcaacgtga taaggaaaaa
gaattgcact ttaacattaa tattgacaag gaggagggca ccacacaaaa agttaggtgt
aacagaaaat catgaaacta cgattcctaa tttgatattg gaggattttc tctaaaaaaa
aaaaaataca acaaataaaa aacactcaat gacctgacca tttgatggag tttaagtcaa
taccttcttg aagcatttcc cataatggtg aaagttccct caagaatttt actctgtcag
aaacggcctt acgacgtagt cgatatggtg cactctcagt acaatctgct ctgatgccgc
atagttaagc cagccccgac acccgccaac acccgctgac gcgccctgac gggcttgtct
gctcccggca tccgcttaca gacaagctgt gaccgtctcc gggagctgca tgtgtcagag
gttttcaccg tcatcaccga aacgcgcgag acgaaagggc ctcgtgatac gcctattttt
ataggttaat gtcatgataa taatggtttc ttagtatgat ccaatatcaa aggaaatgat
agcattgaag gatgagacta atccaattga ggagtggcag catatagaac agctaaaggg
tagtgctgaa ggaagcatac gatacccgc atggaatggg ataatatcac aggaggtact
agactacctt tcatcctaca taaatagacg catataagta cgcatttaag cataaacacg
cactatgccg ttcttctcat gtatatatat atacaggcaa cacgcagata taggtgcgac
```

Fig. 17 Cont.

```
gtgaacagtg agctgtatgt gcgcagctcg cgttgcattt tcggaagcgc tcgttttcgg
aaacgctttg aagttcctat tccgaagttc ctattctcta gaaagtatag gaacttcaga
gcgcttttga aaaccaaaag cgctctgaag acgcactttc aaaaaaccaa aaacgcaccg
gactgtaacg agctactaaa atattgcgaa taccgcttcc acaaacattg ctcaaaagta
tctctttgct atatatctct gtgctatatc cctatataac ctacccatcc acctttcgct
ccttgaactt gcatctaaac tcgacctcta cattttttat gtttatctct agtattactc
tttagacaaa aaaattgtag taagaactat tcatagagtg aatcgaaaac aatacgaaaa
tgtaaacatt tcctatacgt agtatataga gacaaaatag aagaaaccgt tcataatttt
ctgaccaatg aagaatcatc aacgctatca ctttctgttc acaaagtatg cgcaatccac
atcggtatag aatataatcg gggatgcctt tatcttgaaa aaatgcaccc gcagcttcgc
tagtaatcag taaacgcggg aagtggagtc aggcttcttt tatggaagag aaaatagaca
ccaaagtagc cttcttctaa ccttaacgga cctacagtgc aaaaagttat caagagactg
cattatagag cgcacaaagg agaaaaaaag taatctaaga tgctttgtta gaaaaatagc
gctctcggga tgcattttg tagaacaaaa aagaagtata gattctttgt tggtaaaata
gcgctctcgc gttgcatttc tgttctgtaa aaatgcagct cagattcttt gtttgaaaaa
ttagcgctct cgcgttgcat ttttgtttta caaaaatgaa gcacagattc ttcgttggta
aaatagcgct ttcgcgttgc atttctgttc tgtaaaaatg cagctcagat tctttgtttg
aaaaattagc gctctcgcgt tgcattttg ttctacaaaa tgaagcacag atgcttcgtt
caggtggcac ttttcgggga aatgtgcgcg gaaccccctat ttgtttattt ttctaaatac
attcaaatat gtatccgctc atgagacaat aaccctgata aatgcttcaa taatattgaa
aaaggaagag tatgagtatt caacatttcc gtgtcgccct tattcccttt tttgcggcat
tttgccttcc tgtttttgct cacccagaaa cgctggtgaa agtaaaagat gctgaagatc
agttgggtgc acgagtgggt tacatcgaac tggatctcaa cagcggtaag atccttgaga
gttttcgccc cgaagaacgt tttccaatga tgagcacttt taaagttctg ctatgtggcg
cggtattatc ccgtattgac gccgggcaag agcaactcgg tcgccgcata cactattctc
agaatgactt ggttgagtac tcaccagtca cagaaaagca tcttacggat ggcatgacag
taagagaatt atgcagtgct gccataacca tgagtgataa cactgcggcc aacttacttc
tgacaacgat cggaggaccg aaggagctaa ccgcttttt gcacaacatg ggggatcatg
taactcgcct tgatcgttgg gaaccggagc tgaatgaagc cataccaaac gacgagcgtg
acaccacgat gcctgtagca atggcaacaa cgttgcgcaa actattaact ggcgaactac
ttactctagc ttcccggcaa caattaatag actggatgga ggcggataaa gttgcaggac
cacttctgcg ctcggccctt ccggctggct ggtttattgc tgataaatct ggagccggtg
agcgtgggtc tcgcggtatc attgcagcac tggggccaga tggtaagccc tcccgtatcg
tagttatcta cacgacgggg agtcaggcaa ctatggatga acgaaataga cagatcgctg
agataggtgc ctcactgatt aagcattggt aactgtcaga ccaagtttac tcatatatac
tttagattga ttttaaaactt cattttaat ttaaaaggat ctaggtgaag atcctttttg
ataatctcat gaccaaaatc ccttaacgtg agttttcgtt ccactgagcg tcagaccccg
tagaaaagat caaaggatct tcttgagatc ctttttttct gcgcgtaatc tgctgcttgc
aaacaaaaaa accaccgcta ccagcggtgg tttgtttgcc ggatcaagag ctaccaactc
tttttccgaa ggtaactggc ttcagcagag cgcagatacc aaatactgtc cttctagtgt
agccgtagtt aggccaccac ttcaagaact ctgtagcacc gcctacatac ctcgctctgc
taatcctgtt accagtggct gctgccagtg gcgataagtc gtgtcttacc gggttggact
caagacgata gttaccggat aaggcgcagc ggtcgggctg aacggggggt tcgtgcacac
agcccagctt ggagcgaacg acctacaccg aactgagata cctacagcgt gagctatgag
aaagcgccac gcttcccgaa gggagaaagg cggacaggta tccggtaagc ggcagggtcg
gaacaggaga gcgcacgagg gagcttccag ggggaaacgc ctggtatctt tatagtcctg
tcgggtttcg ccacctctga cttgagcgtc gatttttgtg atgctcgtca ggggggcgga
gcctatggaa aaacgccagc aacgcggcct ttttacggtt cctggccttt tgctggcctt
ttgctcacat gttctttcct gcgttatccc ctgattctgt ggataaccgt attaccgcct
ttgagtgagc tgataccgct cgccgcagcc gaacgaccga gcgcagcgag tcagtgagcg
aggaagcgga agagcgccca atacgcaaac cgcctctccc cgcgcgttgg ccgattcatt
aatgcagctg gcacgacagg tttcccgact ggaaagcggg cagtgagcgc aacgcaatta
atgtgagtta cctcactcat taggcacccc aggctttaca ctttatgctt ccggctccta
tgttgtgtgg aattgtgagc ggataacaat ttcacacagg aaacagctat gaccatgatt
acgccaagcg cgcaattaac cctcactaaa gggaacaaaa gctggagctc caccgcggga
tttcgaaact aagttcttgg tgttttaaaa ctaaaaaaaa gactaactat aaaagtgaaa
tttaagaagt ttaagaaata gatttacaga attacaatca atacctaccg tctttatata
```

FIG. 17 Cont.

```
cttattagtc aagtagggga ataatttcag ggaactggtt tcaacctttt ttttcagctt
tttccaaatc agagagagca gaaggtaata gaaggtgtaa gaaaatgaga tagatacatg
cgtgggtcaa ttgccttgtg tcatcattta ctccaggcag gttgcatcac tccattgagg
ttgtgcccgt ttttttgcctg tttgtgcccc tgttctctgt agttgcgcta agagaatgga
cctatgaact gatggttggt gaagaaaaca atattttggt gctgggattc ttttttttttc
tggatgccag cttaaaaagc gggctccatt atatttagtg gatgccagga ataaactgtt
cacccagaca cctacgatgt tatatattct gtgtaacccg cccctatttt tgggcatgta
cgggttacag cagaattaaa aggctaattt tttgactaaa taaagttagg aaaatcacta
ctattaatta tttacgtatt ctttgaaatg gcagtattga taatgataaa ctcgaaatca
ctagtggatc cgcccagc
``` pZP2-YACBP Vector (SEQ ID NO:49)

```
ggccgcaagt gtggatgggg aagtgagtgc ccggttctgt gtgcacaatt ggcaatccaa
gatggatgga ttcaacacag ggatatagcg agctacgtgg tggtgcgagg atatagcaac
ggatatttat gtttgacact tgagaatgta cgatacaagc actgtccaag tacaatacta
aacatactgt acatactcat actcgtaccc gggcaacggt ttcacttgag tgcagtggct
agtgctctta ctcgtacagt gtgcaatact gcgtatcata gtctttgatg tatatcgtat
tcattcatgt tagttgcgta cgggcgtcgt tgcttgtgtg attttttgagg acccatccct
ttggtatata agtatactct ggggttaagg ttcccgtgt agtctaggtt atagttttca
tgtgaaatac cgagagccga gggagaataa acgggggtat ttggacttgt ttttttcgcg
gaaaagcgtc gaatcaaccc tgcgggcctt gcaccatgtc cacgacgtgt ttctcgcccc
aattcgcccc ttgcacgtca aaattaggcc tccatctaga cccctccata acatgtgact
gtggggaaaa gtataaggga accatgcaa ccatagacga cgtgaaagac ggggaggaac
caatggaggc caaagaaatg gggtagcaac agtccaggag acagacaagg agacaaggag
agggcgcccg aaagatcgga aaaacaaaca tgtccaattg gggcagtgac ggaaacgaca
cggacacttc agtacaatgg accgaccatc tccaagccag ggttattccg gtatcacctt
ggccgtaacc tcccgctggt acctgatatt gtacacgttc acattcaata tactttcagc
tacaataaga gaggctgttt gtcgggcatg tgtgtccgtc gtatgggtg atgtccgagg
gcgaaattcg ctacaagctt aactctggcg cttgtccagt atgaatagac aagtcaagac
cagtggtgcc atgattgaca gggaggtaca agacttcgat actcgagcat tactcggact
tgtggcgatt gaacagacgg gcgatcgctt ctcccccgta ttgccggcgc gccagctgca
ttaatgaatc ggccaacgcg cggggagagg cggtttgcgt attgggcgct cttccgcttc
ctcgctcact gactcgctgc gctcggtcgt tcggctgcgg cgagcggtat cagctcactc
aaaggcggta atacggttat ccacagaatc aggggataac gcaggaaaga acatgtgagc
aaaaggccag caaaaggcca ggaaccgtaa aaaggccgcg ttgctggcgt ttttccatag
gctccgcccc cctgacgagc atcacaaaaa tcgacgctca agtcagaggt ggcgaaaccc
gacaggacta taaagatacc aggcgtttcc ccctggaagc tccctcgtgc gctctcctgt
tccgaccctg ccgcttaccg gatacctgtc cgcctttctc ccttcgggaa gcgtggcgct
ttctcatagc tcacgctgta ggtatctcag ttcggtgtag tcgttcgct ccaagctggg
ctgtgtgcac gaaccccccg ttcagcccga ccgctgcgcc ttatccggta actatcgtct
tgagtccaac ccggtaagac acgacttatc gccactggca gcagccactg gtaacaggat
tagcagagcg aggtatgtag gcggtgctac agagttcttg aagtggtggc ctaactacgg
ctacactaga agaacagtat ttggtatctg cgctctgctg aagccagtta ccttcggaaa
aagagttggt agctcttgat ccggcaaaca aaccaccgct ggtagcggtg ttttttttgt
ttgcaagcag cagattacgc gcagaaaaaa aggatctcaa gaagatcctt tgatcttttc
tacggggtct gacgctcagt ggaacgaaaa ctcacgttaa gggattttgg tcatgagatt
atcaaaaagg atcttcacct agatcctttt aaattaaaaa tgaagtttta atcaatcta
aagtatatat gagtaaactt ggtctgacag ttaccaatgc ttaatcagtg aggcacctat
ctcagcgatc tgtctatttc gttcatccat agttgcctga ctccccgtcg tgtagataac
tacgatacgg gagggcttac catctggccc cagtgctgca atgataccgc gagacccacg
ctcaccggct ccagatttat cagcaataaa ccagccagcc ggaagggcc agcgcagaag
tggtcctgca actttatccg cctccatcca gtctattaat tgttgccggg aagctagagt
aagtagttcg ccagttaata gtttgcgcaa cgttgttgcc attgctacag gcatcgtggt
```

FIG. 17 Cont.

```
gtcacgctcg tcgtttggta tggcttcatt cagctccggt tcccaacgat caaggcgagt
tacatgatcc cccatgttgt gcaaaaaagc ggttagctcc ttcggtcctc cgatcgttgt
cagaagtaag ttggccgcag tgttatcact catggttatg cagcactgc ataattctct
tactgtcatg ccatccgtaa gatgcttttc tgtgactggt gagtactcaa ccaagtcatt
ctgagaatag tgtatgcggc gaccgagttg ctcttgcccg gcgtcaatac gggataatac
cgcgccacat agcagaactt taaaagtgct catcattgga aaacgttctt cggggcgaaa
actctcaagg atcttaccgc tgttgagatc cagttcgatg taacccactc gtgcacccaa
ctgatcttca gcatctttta ctttcaccag cgtttctggg tgagcaaaaa caggaaggca
aaatgccgca aaaaggggaa taagggcgac acggaaatgt tgaatactca tactcttcct
ttttcaatat tattgaagca tttatcaggg ttattgtctc atgagcggat acatatttga
atgtatttag aaaaataaac aaatagggt tccgcgcaca tttccccgaa aagtgccacc
tgatgcggtg tgaaataccg cacagatgcg taaggagaaa ataccgcatc aggaaattgt
aagcgttaat attttgttaa aattcgcgtt aaattttttgt taaatcagct cattttttaa
ccaataggcc gaaatcggca aaatcccttta taaatcaaaa gaatagaccg atatagggtt
gagtgttgtt ccagtttgga acaagagtcc actattaaag aacgtggact ccaacgtcaa
agggcgaaaa accgtctatc agggcgatgg cccactacgt gaaccatcac cctaatcaag
tttttttgggg tcgaggtgcc gtaaagcact aaatcggaac cctaaaggga gcccccgatt
tagagcttga cggggaaagc cggcgaacgt ggcgagaaag gaagggaaga aagcgaaagg
agcgggcgct agggcgctgg caagtgtagc ggtcacgctg cgcgtaacca ccacacccgc
cgcgcttaat gcgccgctac agggcgcgtc cattcgccat tcaggctgcg caactgttgg
gaagggcgat cggtgcgggc ctcttcgcta ttacgccagc tggcgaaagg gggatgtgct
gcaaggcgat taagttgggt aacgccaggg ttttcccagt cacgacgttg taaaacgacg
gccagtgaat tgtaatacga ctcactatag ggcgaattgg gcccgacgtc gcatgcgctg
atgcacttt ggtctgaaag agatgcattt tgaatcccaa acttgcagtg cccaagtgac
atacatctcc gcgttttgga aaatgttcag aaacagttga ttgtgttgga atggggaatg
gggaatggaa aaatgactca agtatcaatt ccaaaaactt ctctggctgg cagtacctac
tgtccatact actgcatttt ctccagtcag gccactctat actcgacgac acagtagtaa
aacccagata attttcgacat aaacaagaaa acagacccaa taatatttat atatagtcag
ccgtttgtcc agttcagact gtaatagccg aaaaaaaatc caaagtttct attctaggaa
aatatattcc aatattttta attcttaatc tcatttattt tattctagcg aaatacattt
cagctacttg agacatgtga tacccacaaa tcggattcgg actcggttgt tcagaagagc
atatggcatt cgtgctcgct tgttcacgta ttcttcctgt tccatctctt ggccgacaat
cacacaaaaa tggggttttt tttttaattc taatgattca ttacagcaaa attgagatat
agcagaccac gtattccata atcaccaagg aagttcttgg gcgtcttaat taagtcatac
acaagtcagc tttcttcgag cctcatataa gtataagtag ttcaacgtat tagcactgta
cccagcatct ccgtatcgag aaacacaaca acatgcccca ttggacagat catgcggata
cacaggttgt gcagtatcat acatactcga tcagacaggt cgtctgacca tcatacaagc
tgaacaagcg ctccatactt gcacgctctc tatatacaca gttaaattac atatccatag
tctaacctct aacagttaat cttctggtaa gcctcccagc cagccttctg gtatcgcttg
gcctcctcaa taggatctcg gttctggccg tacagacctc ggccgacaat tatgatatcc
gttccggtag acatgacatc ctcaacagtt cggtactgct gtccgagagc gtctcccttg
tcgtcaagac ccaccccggg ggtcagaata agccagtcct cagagtcgcc cttaggtcgg
ttctgggcaa tgaagccaac cacaaactcg gggtcggatc gggcaagctc aatggtctgc
ttggagtact cgccagtggc cagagagccc ttgcaagaca gctcggccag catgagcaga
cctctggcca gcttctcgtt gggagagggg actaggaact ccttgtactg ggagttctcg
tagtcagaga cgtcctcctt cttctgttca gagacagttt cctcggcacc agctcgcagg
ccagcaatga ttccggttcc gggtacaccg tgggcgttgg tgatatcgga ccactcggcg
attcggtgac accggtactg gtgcttgaca gtgttccaa tatctgcgaa ctttctgtcc
tcgaacagga agaaaccgtg cttaagagca agttccttga ggggagcac agtgccggcg
taggtgaagt cgtcaatgat gtcgatatgg gttttgatca tgcacacata aggtccgacc
ttatcggcaa gctcaatgag ctccttggtg gtggtaacat ccagagaagc acacaggttg
gttttcttgg ctgccacgag cttgagcact cgagcggcaa aggcggactt gtggacgtta
gctcgagctt cgtaggaggg cattttggtg gtgaagagga gactgaaata aatttagtct
gcagaacttt ttatcggaac cttatctggg gcagtgaagt atatgttatg gtaatagtta
```

FIG. 17 Cont.

```
cgagttagtt gaacttatag atagactgga ctatacggct atcggtccaa attagaaaga
acgtcaatgg ctctctgggc gtcgcctttg ccgacaaaaa tgtgatcatg atgaaagcca
gcaatgacgt tgcagctgat attgttgtcg gccaaccgcg ccgaaaacgc agctgtcaga
cccacagcct ccaacgaaga atgtatcgtc aaagtgatcc aagcacactc atagttggag
tcgtactcca aaggcggcaa tgacgagtca gacagatact cgtcaaacgg taggttagtg
cttggtatat gagttgtagg catgacaatt tggaaggggg tggactttgg gaatattgtg
ggatttcaat accttagttt gtacagggta attgttacaa atgatacaaa gaactgtatt
tcttttcatt tgttttaatt ggttgtatat caagtccgtt agacgagctc agtgccttgg
cttttggcac tgtatttcat ttttagaggt acactacatt cagtgaggta tggtaaggtt
gagggcataa tgaaggcacc ttgtactgac agtcacagac ctctcaccga gaattttatg
agatatactc gggttcattt taggctcatc gatgagccta aaatgaaccc gagtatatct
cataaaattc tcggtgagag gtctgtgact gtcagtacaa ggtgccttca ttatgccctc
aaccttacca tacctcactg aatgtagtgt acctctaaaa atgaaataca gtgccaaaag
ccaaggcact gagctcgtct aacggacttg atatacaacc aattaaaaca atgaaaaga
aatacagttc tttgtatcat ttgtaacaat taccctgtac aaactaaggt attgaaatcc
cacaatattc ccaaagtcca cccctttcca aattgtcatg cctacaactc atataccaag
cactaaccta ccgtttaaac agtgtacgca gatctactat agaggaacat ttaaattgcc
ccggagaaga cggccaggcc gcctagatga caaattcaac aactcacagc tgactttctg
ccattgccac tagggggggg cctttttata tggccaagcc aagctctcca cgtcggttgg
gctgcaccca acaataaatg ggtagggttg caccaacaaa gggatgggat gggggggtaga
agatacgagg ataacgggc tcaatggcac aaataagaac gaatactgcc attaagactc
gtgatccagc gactgacacc attgcatcat ctaagggcct caaaactacc tcggaactgc
tgcgctgatc tggacaccac agaggttccg agcactttag gttgcaccaa atgtcccacc
aggtgcaggc agaaaacgct ggaacagcgt gtacagtttg tcttaacaaa aagtgagggc
gctgaggtcg agcagggtgg tgtgacttgt tatagccttt agagctgcga aagcgcgtat
ggatttggct catcaggcca gattgagggt ctgtggacac atgtcatgtt agtgtacttc
aatcgccccc tggatatagc cccgacaata ggccgtggcc tcattttttt gccttccgca
catttccatt gctcggtacc cacaccttgc ttctcctgca cttgccaacc ttaatactgg
tttacattga ccaacatctt acaagcgggg ggcttgtcta gggtatatat aaacagtggc
tctcccaatc ggttgccagt ctcttttttc cttctttcc ccacagattc gaaatctaaa
ctacacatca cagaattccg agccgtgagt atccacgaca agatcagtgt cgagacgacg
cgttttgtgt aatgacacaa tccgaaagtc gctagcaaca cacactctct acacaaacta
acccagctct ggtaccatgg cttccgccga attcaccgcc gctgccgact ctgtgcagaa
gcttcccaag actccttccg acgacgagct tcttgagctc tacggactgt acaagcaggc
caccgtcggc gacaacaaca ccgaccgacc cggcgccttc aacttcaagg ccaagtacaa
gtgggacgcc tgggacaagc tcaagggcaa gtctcaggag gaggctgagc aggagtacat
tgctcttgtc cagacccttt ccgacaagta caactaagc
``` pGPD-425 Plasmid (SEQ ID NO:50)
```
ggtggagctc cagcttttgt tccctttagt gagggttaat tgcgcgcttg gcgtaatcat
ggtcatagct gtttcctgtg tgaaattgtt atccgctcac aattccacac aacataggag
ccggaagcat aaagtgtaaa gcctggggtg cctaatgagt gaggtaactc acattaattg
cgttgcgctc actgcccgct ttccagtcgg gaaacctgtc gtgccagctg cattaatgaa
tcggccaacg cgcggggaga ggcggtttgc gtattgggcg ctcttccgct tcctcgctca
ctgactcgct gcgctcggtc gttcggctgc ggcgagcggt atcagctcac tcaaaggcgg
taatacggtt atccacagaa tcagggggata acgcaggaaa gaacatgtga gcaaaaggcc
agcaaaaggc caggaaccgt aaaaaggccg cgttgctggc gtttttccat aggctccgcc
cccctgacga gcatcacaaa aatcgacgct caagtcagag gtggcgaaac ccgacaggac
tataaagata ccaggcgttt ccccctggaa gctccctcgt gcgctctcct gttccgaccc
tgccgcttac cggatacctg tccgcctttc tcccttcggg aagcgtggcg ctttctcata
gctcacgctg taggtatctc agttcggtgt aggtcgttcg ctccaagctg gggctgtgtgc
acgaaccccc cgttcagccc gaccgctgcg ccttatccgg taactatcgt cttgagtcca
acccggtaag acacgactta tcgccactgg cagcagccac tggtaacagg attagcagag
```

FIG. 17 Cont.

```
cgaggtatgt aggcggtgct acagagttct tgaagtggtg gcctaactac ggctacacta
gaaggacagt atttggtatc tgcgctctgc tgaagccagt taccttcgga aaaagagttg
gtagctcttg atccggcaaa caaaccaccg ctggtagcgg tggttttttt gtttgcaagc
agcagattac gcgcagaaaa aaaggatctc aagaagatcc tttgatcttt tctacggggt
ctgacgctca gtggaacgaa aactcacgtt aagggatttt ggtcatgaga ttatcaaaaa
ggatcttcac ctagatcctt ttaaattaaa aatgaagttt taaatcaatc taaagtatat
atgagtaaac ttggtctgac agttaccaat gcttaatcag tgaggcacct atctcagcga
tctgtctatt tcgttcatcc atagttgcct gactccccgt cgtgtagata actacgatac
gggagggctt accatctggc cccagtgctg caatgatacc gcgagaccca cgctcaccgg
ctccagattt atcagcaata accagccag ccggaagggc cgagcgcaga agtggtcctg
caactttatc cgcctccatc cagtctatta attgttgccg ggaagctaga gtaagtagtt
cgccagttaa tagtttgcgc aacgttgttg ccattgctac aggcatcgtg gtgtcacgct
cgtcgtttgg tatggcttca ttcagctccg gttcccaacg atcaaggcga gttacatgat
cccccatgtt gtgcaaaaaa gcggttagct ccttcggtcc tccgatcgtt gtcagaagta
agttggccgc agtgttatca ctcatggtta tggcagcact gcataattct cttactgtca
tgccatccgt aagatgcttt tctgtgactg gtgagtactc aaccaagtca ttctgagaat
agtgtatgcg gcgaccgagt tgctcttgcc cggcgtcaat acgggataat accgcgccac
atagcagaac tttaaaagtg ctcatcattg gaaaacgttc ttcggggcga aaactctcaa
ggatcttacc gctgttgaga tccagttcga tgtaacccac tcgtgcaccc aactgatctt
cagcatcttt tactttcacc agcgtttctg ggtgagcaaa aacaggaagg caaaatgccg
caaaaaaggg aataagggcg acacggaaat gttgaatact catactcttc ctttttcaat
attattgaag catttatcag ggttattgtc tcatgagcgg atacatattt gaatgtattt
agaaaaataa acaaataggg gttccgcgca catttccccg aaaagtgcca cctgaacgaa
gcatctgtgc ttcattttgt agaacaaaaa tgcaacgcga gagcgctaat ttttcaaaca
aagaatctga gctgcatttt tacagaacag aaatgcaacg cgaaagcgct attttaccaa
cgaagaatct gtgcttcatt tttgtaaaac aaaaatgcaa cgcgagagcg ctaattttt c
aaacaaagaa tctgagctgc attttttacag aacagaaatg caacgcgaga gcgctatttt
accaacaaag aatctatact tcttttttgt tctacaaaaa tgcatcccga gagcgctatt
tttctaacaa agcatcttag attactttt ttctcctttg tgcgctctat aatgcagtct
cttgataact ttttgcactg taggtccgtt aaggttagaa gaaggctact ttggtgtcta
ttttctcttc cataaaaaaa gcctgactcc acttcccgcg tttactgatt actagcgaag
ctgcgggtgc attttttcaa gataaaggca tccccgatta tattctatac cgatgtggat
tgcgcatact ttgtaacag aaagtgatag cgttgatgat tcttcattgg tcagaaaatt
atgaacggtt tcttctattt tgtctctata tactacgtat aggaaatgtt tacattttcg
tattgttttc gattcactct atgaatagtt cttactacaa ttttttgtc taaagagtaa
tactagagat aaacataaaa aatgtagagg tcgagtttag atgcaagttc aaggagcgaa
aggtggatgg gtaggttata tagggatata gcacagagat atatagcaaa gagatacttt
tgagcaatgt ttgtggaagc ggtattcgca atatttagt agctcgttac agtccggtgc
gttttttggtt ttttgaaagt gcgtcttcag agcgcttttg gttttcaaaa gcgctctgaa
gttcctatac tttctagaga ataggaactt cggaatagga acttcaaagc gtttccgaaa
acgagcgctt ccgaaaatgc aacgcgagct gcgcacatac agctcactgt tcacgtcgca
cctatatctg cgtgttgcct gtatatatat atacatgaga agaacggcat agtgcgtgtt
tatgcttaaa tgcgtactta tatgcgtcta tttatgtagg atgaaaggta gtctagtacc
tcctgtgata ttatcccatt ccatgcgggg tatcgtatgc ttccttcagc actaccctt t
agctgttcta tatgctgcca ctcctcaatt ggattagtct catccttcaa tgctatcatt
tcctttgata ttggatcata ctaagaaacc attattatca tgacattaac ctataaaaat
aggcgtatca cgaggccctt tcgtctcgcg cgtttcggtg atgacggtga aaacctctga
cacatgcagc tcccggagac ggtcacagct tgtctgtaag cggatgccgg gagcagacaa
gcccgtcagg gcgcgtcagc gggtgttggc gggtgtcggg gctggcttaa ctatgcggca
tcagagcaga ttgtactgag agtgcaccat atcgactacg tcgtaaggcc gtttctgaca
gagtaaaatt cttgagggaa cttt.caccat tatgggaaat gcttcaagaa ggtattgact
taaactccat caaatggtca ggtcattgag tgttttttat ttgttgtatt ttttttttt
tagagaaaat cctccaatat caaattagga atcgtagttt catgattttc tgttacacct
aacttttgt gtggtgccct cctccttgtc aatattaatg ttaaagtgca attcttttc
```

FIG. 17 Cont.

```
cttatcacgt tgagccatta gtatcaattt gcttacctgt attcctttac tatcctcctt
tttctccttc ttgataaatg tatgtagatt gcgtatatag tttcgtctac cctatgaaca
tattccattt tgtaatttcg tgtcgtttct attatgaatt tcatttataa agtttatgta
caaatatcat aaaaaaagag aatcttttta agcaaggatt ttcttaactt cttcggcgac
agcatcaccg acttcggtgg tactgttgga accacctaaa tcaccagttc tgatacctgc
atccaaaacc tttttaactg catcttcaat ggccttacct tcttcaggca agttcaatga
caatttcaac atcattgcag cagacaagat agtggcgata gggtcaacct tattctttgg
caaatctgga gcagaaccgt ggcatggttc gtacaaacca aatgcggtgt tcttgtctgg
caaagaggcc aaggacgcag atggcaacaa acccaaggaa cctgggataa cggaggcttc
atcggagatg atatcaccaa acatgttgct ggtgattata ataccattta ggtgggttgg
gttcttaact aggatcatgg cggcagaatc aatcaattga tgttgaacct tcaatgtagg
gaattcgttc ttgatggttt cctccacagt ttttctccat aatcttgaag aggccaaaag
attagcttta tccaaggacc aaataggcaa tggtggctca tgttgtaggg ccatgaaagc
ggccattctt gtgattcttt gcacttctgg aacggtgtat tgttcactat cccaagcgac
accatcacca tcgtcttcct ttctcttacc aaagtaaata cctcccacta attctctgac
aacaacgaag tcagtacctt tagcaaattg tggcttgatt ggagataagt ctaaaagaga
gtcggatgca aagttacatg gtcttaagtt ggcgtacaat tgaagttctt tacggatttt
tagtaaacct tgttcaggtc taacactacc ggtacccat ttaggaccag ccacagcacc
taacaaaacg gcatcaacct tcttggaggc ttccagcgcc tcatctggaa gtgggacacc
tgtagcatcg atagcagcac caccaattaa atgattttcg aaatcgaact tgacattgga
acgaacatca gaaatagctt taagaacctt aatggcttcg gctgtgattt cttgaccaac
gtggtcacct ggcaaaacga cgatcttctt aggggcagac ataggggcag acattagaat
ggtatatcct tgaaatatat atatatattg ctgaaatgta aaggtaaga aaagttagaa
agtaagacga ttgctaacca cctattggaa aaaacaatag gtccttaaat aatattgtca
acttcaagta ttgtgatgca agcatttagt catgaacgct tctctattct atatgaaaag
ccggttccgg cctctcacct ttccttttc tcccaatttt tcagttgaaa aaggtatatg
cgtcaggcga cctctgaaat taacaaaaaa tttccagtca tcgaatttga ttctgtgcga
tagcgcccct gtgtgttctc gttatgttga ggaaaaaaat aatggttgct aagagattcg
aactcttgca tcttacgata cctgagtatt cccacagtta actgcggtca agatatttct
tgaatcaggc gccttagacc gctcggccaa acaaccaatt acttgttgag aaatagagta
taattatcct ataaatataa cgttttgaa cacacatgaa caaggaagta caggacaatt
gattttgaag agaatgtgga ttttgatgta attgttggga ttccattttt aataaggcaa
taatattagg tatgtggata tactagaagt tctcctcgac cgtcgatatg cggtgtgaaa
taccgcacag atgcgtaagg agaaaatacc gcatcaggaa attgtaaacg ttaatatttt
gttaaaattc gcgttaaatt tttgttaaat cagctcattt tttaaccaat aggccgaaat
cggcaaaatc ccttataaat caaaagaata gaccgagata gggttgagtg ttgttccagt
ttggaacaag agtccactat taaagaacgt ggactccaac gtcaaagggc gaaaaaccgt
ctatcagggc gatggcccac tacgtgaacc atcaccctaa tcaagttttt tgggggtcgag
gtgccgtaaa gcactaaatc ggaaccctaa agggagcccc cgatttagag cttgacgggg
aaagccggcg aacgtggcga gaaggaagg gaagaaagcg aaaggagcgg gcgctagggc
gctggcaagt gtagcggtca cgctgcgcgt aaccaccaca cccgccgcgc ttaatgcgcc
gctacagggc gcgtcgcgcc attcgccatt caggctgcgc aactgttggg aagggcgatc
ggtgcgggcc tcttcgctat tacgccagct ggcgaaaggg gatgtgctg caaggcgatt
aagttgggta acgccagggt tttcccagtc acgacgttgt aaaacgacgg ccagtgagcg
cgcgtaatac gactcactat agggcgaatt gggtaccggg ccccccctcg aggtcgacgg
tatcgataag cttgatatcg aattcctgca gcccggggga tccactagtg atttcgagtt
tatcattatc aatactgcca tttcaaagaa tacgtaaata attaatagta gtgatttttcc
taactttatt tagtcaaaaa attagccttt taattctgct gtaacccgta catgcccaaa
ataggggggcg ggttacacag aatatataac atcgtaggtg tctgggtgaa cagtttattc
ctggcatcca ctaaatataa tggagcccgc ttttaagct ggcatccaga aaaaaaaga
atcccagcac caaaatattg ttttcttcac caaccatcag ttcataggtc cattctctta
gcgcaactac agagaacagg ggcacaaaca ggcaaaaaac gggcacaacc tcaatggagt
gatgcaacct gcctggagta aatgatgaca caaggcaatt gacccacgca tgtatctatc
tcattttctt acaccttcta ttaccttctg ctctctctga tttggaaaaa gctgaaaaaa
aaggttgaaa ccagttccct gaaattattc ccctacttga ctaataagta tataaagacg
```

FIG. 17 Cont.

```
            gtaggtattg attgtaattc tgtaaatcta tttcttaaac ttcttaaatt ctacttttat
            agttagtctt tttttagtt ttaaaacacc aagaacttag tttcgaaatc ccgc
``` pFBAIN-Mod-1 vector (SEQ ID NO:51)

```
            gcggccgcaa gtgtggatgg ggaagtgagt gcccggttct gtgtgcacaa ttggcaatcc
            aagatggatg gattcaacac agggatatag cgagctacgt ggtggtgcga ggatatagca
            acggatattt atgtttgaca cttgagaatg tacgatacaa gcactgtcca agtacaatac
            taaacatact gtacatactc atactcgtac ccgggcaacg gtttcacttg agtgcagtgg
            ctagtgctct tactcgtaca gtgtgcaata ctgcgtatca tagtctttga tgtatatcgt
            attcattcat gttagttgcg tacgagccgg aagcataaag tgtaaagcct ggggtgccta
            atgagtgagc taactcacat taattgcgtt gcgctcactg cccgctttcc agtcgggaaa
            cctgtcgtgc cagctgcatt aatgaatcgg ccaacgcgcg gggagaggcg gtttgcgtat
            tgggcgctct tccgcttcct cgctcactga ctcgctgcgc tcggtcgttc ggctgcggcg
            agcggtatca gctcactcaa aggcggtaat acggttatcc acagaatcag gggataacgc
            aggaaagaac atgtgagcaa aaggccagca aaaggccagg aaccgtaaaa aggccgcgtt
            gctggcgttt ttccataggc tccgcccccc tgacgagcat cacaaaaatc gacgctcaag
            tcagaggtgg cgaaacccga caggactata agataccag gcgtttcccc ctggaagctc
            cctcgtgcgc tctcctgttc cgaccctgcc gcttaccgga tacctgtccg cctttctccc
            ttcgggaagc gtggcgcttt ctcatagctc acgctgtagg tatctcagtt cggtgtaggt
            cgttcgctcc aagctgggct gtgtgcacga accccccgtt cagcccgacc gctgcgcctt
            atccggtaac tatcgtcttg agtccaaccc ggtaagacac gacttatcgc cactggcagc
            agccactggt aacaggatta gcagagcgag gtatgtaggc ggtgctacag agttcttgaa
            gtggtggcct aactacggct acactagaag gacagtattt ggtatctgcg ctctgctgaa
            gccagttacc ttcggaaaaa gagttggtag ctcttgatcc ggcaaacaaa ccaccgctgg
            tagcggtggt tttttgttt gcaagcagca gattacgcgc agaaaaaaag gatctcaaga
            agatcctttg atcttttcta cggggtctga cgctcagtgg aacgaaaact cacgttaagg
            gattttggtc atgagattat caaaaaggat cttcacctag atcctttaa attaaaaatg
            aagttttaaa tcaatctaaa gtatatatga gtaaacttgg tctgacagtt accaatgctt
            aatcagtgag gcacctatct cagcgatctg tctatttcgt tcatccatag ttgcctgact
            ccccgtcgtg tagataacta cgatacggga gggcttacca tctggcccca gtgctgcaat
            gataccgcga gacccacgct caccggctcc agatttatca gcaataaacc agccagccgg
            aagggccgag cgcagaagtg gtcctgcaac tttatccgcc tccatccagt ctattaattg
            ttgccgggaa gctagagtaa gtagttcgcc agttaatagt ttgcgcaacg ttgttgccat
            tgctacaggc atcgtggtgt cacgctcgtc gtttggtatg gcttcattca gctccggttc
            ccaacgatca aggcgagtta catgatcccc catgttgtgc aaaaaagcgg ttagctcctt
            cggtcctccg atcgttgtca gaagtaagtt ggccgcagtg ttatcactca tggttatggc
            agcactgcat aattctctta ctgtcatgcc atccgtaaga tgcttttctg tgactggtga
            gtactcaacc aagtcattct gagaatagtg tatgcggcga ccgagttgct cttgcccggc
            gtcaatacgg gataataccg cgccacatag cagaacttta aaagtgctca tcattggaaa
            acgttcttcg gggcgaaaac tctcaaggat cttaccgctg ttgagatcca gttcgatgta
            acccactcgt gcacccaact gatcttcagc atcttttact ttcaccagcg tttctgggtg
            agcaaaaaca ggaaggcaaa atgccgcaaa aagggaata agggcgacac ggaaatgttg
            aatactcata ctcttccttt tcaatatta ttgaagcatt tatcagggtt attgtctcat
            gagcggatac atatttgaat gtatttagaa aaataaacaa ataggggttc cgcgcacatt
            tccccgaaaa gtgccacctg acgcgccctg tagcggcgca ttaagcgcgg cgggtgtggt
            ggttacgcgc agcgtgaccg ctacacttgc cagcgcccta gcgcccgctc ctttcgcttt
            cttcccttcc tttctcgcca cgttcgccgg ctttccccgt caagctctaa atcggggggct
            ccctttaggg ttccgattta gtgctttacg gcacctcgac cccaaaaaac ttgattaggg
            tgatggttca cgtagtgggc catcgcccctg atagacggtt tttcgccctt tgacgttgga
            gtccacgttc tttaatagtg actcttgttc caaactgga acaacactca accctatctc
            ggtctattct tttgatttat aagggatttt gccgatttcg gcctattggt taaaaaatga
            gctgatttaa caaaaattta acgcgaattt taacaaaata ttaacgctta caatttccat
            tcgccattca ggctgcgcaa ctgttgggaa gggcgatcgg tgcggcctc ttcgctatta
            cgccagctgg cgaaaggggg atgtgctgca aggcgattaa gttgggtaac gccagggttt
```

FIG. 17 Cont.

```
tcccagtcac gacgttgtaa aacgacggcc agtgaattgt aatacgactc actatagggc
gaattgggta ccgggccccc cctcgaggtc gatggtgtcg ataagcttga tatcgaattc
atgtcacaca aaccgatctt cgcctcaagg aaacctaatt ctacatccga gagactgccg
agatccagtc tacactgatt aattttcggg ccaataattt aaaaaaatcg tgttatataa
tattatatgt attatatata tacatcatga tgatactgac agtcatgtcc cattgctaaa
tagacagact ccatctgccg cctccaactg atgttctcaa tatttaaggg gtcatctcgc
attgtttaat aataaacaga ctccatctac cgcctccaaa tgatgttctc aaaatatatt
gtatgaactt attttttatta cttagtatta ttagacaact tacttgcttt atgaaaaaca
cttcctattt aggaaacaat ttataatggc agttcgttca tttaacaatt tatgtagaat
aaatgttata aatgcgtatg ggaaatctta aatatggata gcataaatga tatctgcatt
gcctaattcg aaatcaacag caacgaaaaa aatcccttgt acaacataaa tagtcatcga
gaaatatcaa ctatcaaaga acagctattc acacgttact attgagatta ttattggacg
agaatcacac actcaactgt ctttctctct tctagaaata caggtacaag tatgtactat
tctcattgtt catacttcta gtcatttcat cccacatatt ccttggatttt ctctccaatg
aatgacattc tatcttgcaa attcaacaat tataataaga tataccaaag tagcggtata
gtggcaatca aaaagcttct ctggtgtgct tctcgtattt attttttattc taatgatcca
ttaaaggtat atatttattt cttgttatat aatcctttttg tttattacat gggctggata
cataaaggta ttttgattta attttttgct taaattcaat ccccccctcgt tcagtgtcaa
ctgtaatggt aggaaattac catactttttg aagaagcaaa aaaaatgaaa gaaaaaaaaa
atcgtatttc caggttagac gttccgcaga atctagaatg cggtatgcgg tacattgttc
ttcgaacgta aaagttgcgc tccctgagat attgtacatt tttgcttta caagtacaag
tacatcgtac aactatgtac tactgttgat gcatccacaa cagtttgttt tgtttttttt
tgttttttttt ttttctaatg attcattacc gctatgtata cctacttgta cttgtagtaa
gccgggttat tggcgttcaa ttaatcatag acttatgaat ctgcacggtg tgcgctgcga
gttacttttta gcttatgcat gctacttggg tgtaatattg ggatctgttc ggaaatcaac
ggatgctcaa tcgatttcga cagtaattaa ttaagtcata cacaagtcag ctttcttcga
gcctcatata agtataagta gttcaacgta ttagcactgt acccagcatc tccgtatcga
gaaacacaac aacatgcccc attggacaga tcatgcggat acacaggttg tgcagtatca
tacatactcg atcagacagg tcgtctgacc atcatacaag ctgaacaagc gctccatact
tgcacgctct ctatatacac agttaaatta catatccata gtctaacctc taacagttaa
tcttctggta agcctcccag ccagcctcct ggtatcgctt ggcctcctca ataggatctc
ggttctggcc gtacagacct cggccgacaa ttatgatatc cgttccggta gacatgacat
cctcaacagt tcggtactgc tgtccgagag cgtctccctt gtcgtcaaga cccacccccgg
gggtcagaat aagccagtcc tcagagtcgc ccttaggtcg gttctgggca atgaagccaa
ccacaaactc ggggtcggat cgggcaagct caatggtctg cttggagtac tcgccagtgg
ccagagagcc cttgcaagac agctcggcca gcatgagcag acctctggcc agcttctcgt
tgggagaggg gactaggaac tccttgtact gggagttctc gtagtcagag acgtcctcct
tcttctgttc agagacagtt tcctcggcac cagctcgcag gccagcaatg attccggttc
cgggtacacc gtgggcgttg gtgatatcgg accactcggc gattcggtga caccggtact
ggtgcttgac agtgttgcca atatctgcga actttctgtc ctcgaacagg aagaaccgt
gcttaagagc aagttccttg aggggggagca cagtgccggc gtaggtgaag tcgtcaatga
tgtcgatatg ggttttgatc atgcacacat aaggtccgac cttatcggca agctcaatga
gctccttggt ggtggtaaca tccagagaag cacacaggtt ggttttcttg gctgccacga
gcttgagcac tcgagcggca aaggcggact tgtggacgtt agctcgagct tcgtaggagg
gcattttggt ggtgaagagg agactgaaat aaatttagtc tgcagaactt tttatcggaa
ccttatctgg ggcagtgaag tatatgttat ggtaatagtt acgagttagt tgaacttata
gatagactgg actatacggc tatcggtcca aattagaaag aacgtcaatg gctctctggg
cgtcgccttt gccgacaaaa atgtgatcat gatgaaagcc agcaatgacg ttgcagctga
tattgttgtc ggccaaccgc gccgaaaacg cagctgtcag acccacagcc tccaacgaag
aatgtatcgt caaagtgatc caagcacact catagttgga gtcgtactcc aaaggcggca
atgacgagtc agacagatac tcgtcgaaaa cagtgtacgc agatctacta tagaggaaca
tttaaattgc cccggagaag acggccaggc cgcctagatg acaaattcaa caactcacag
ctgactttct gccattgcca ctagggggggg gccttttttat atggccaagc caagctctcc
acgtcggttg ggctgcaccc aacaataaat gggtagggtt gcaccaacaa agggatggga
tgggggggtag aagatacgag gataacgggg ctcaatggca caaataagaa cgaatactgc
```

FIG. 17 Cont.

```
cattaagact cgtgatccag cgactgacac cattgcatca tctaagggcc tcaaaactac
ctcggaactg ctgcgctgat ctggacacca cagaggttcc gagcacttta ggttgcacca
aatgtcccac caggtgcagg cagaaaacgc tggaacagcg tgtacagttt gtcttaacaa
aaagtgaggg cgctgaggtc gagcagggtg gtgtgacttg ttatagcctt tagagctgcg
aaagcgcgta tggatttggc tcatcaggcc agattgaggg tctgtggaca catgtcatgt
tagtgtactt caatcgcccc ctggatatag ccccgacaat aggccgtggc ctcatttttt
tgccttccgc acatttccat tgctcggtac ccacaccttg cttctcctgc acttgccaac
cttaatactg gtttacattg accaacatct tacaagcggg gggcttgtct agggtatata
taaacagtgg ctctcccaat cggttgccag tctctttttt cctttctttc cccacagatt
cgaaatctaa actacacatc acagaattcc gagccgtgag tatccacgac aagatcagtg
tcgagacgac gcgttttgtg taatgacaca atccgaaagt cgctagcaac acacactctc
tacacaaact aacccagctc tggtaccatg g
```

Chlorampenicol resistance gene (SEQ ID NO:157)
```
atggagaaaaaaatcactggatataccaccgttgatatatcccaatggcatcgtaaagaacattttgaggcatttca
gtcagttgctcaatgtacctataaccagaccgttcagctggatattacggcctttttaaagaccgtaaagaaaaata
agcacaagttttatccggcctttattcacattcttgcccgcctgatgaatgctcatccggaattccgtatggcaatg
aaagacggtgagctggtgatatgggatagtgttcaccttgttacaccgttttccatgagcaaactgaaacgttttc
atcgctctggagtgaataccacgacgatttccggcagtttctacacatatattcgcaagatgtggcgtgttacggtg
aaaacctggcctatttccctaaaggtttattgagaatatgtttttcgtctcagccaatccctgggtgagtttcacc
agtttttgatttaaacgtggccaatatggacaacttcttcgcccccgttttcaccatgggcaaatattatacgcaagg
cgacaaggtgctgatgccgctggcgattcaggttcatcatgccgtttgtgatggcttccatgtcggcagaatgctta
atgaattacaacagtactgcgatgagtggcagggcggggcg
```

Partial kanamycin resistance gene (SEQ ID NO:158)
```
ttagaagaactcgtcaagaaggcgatagaaggcgatgcgctgcgaatcgggagcggcgataccgtaaagcacgagga
agcggtcagcccattcgccgccaagctcttcagcaatatcacgggtagccaacgctatgtcctgatagcggtccgcc
acacccagccggccacagtcgatgaatccagaaaagcggccattttccaccatgatattcggcaagcaggcatcgcc
atgggtcacgacgagatcctcgccgtcgggcatgcgcgccttgagcctggcgaacagttcggctggcgcgagcccct
gatgctcttcgtccagatcatcctgatcgacaagaccggcttccatccgagtacgtgctcgctcgatgcgatgtttc
gcttggtggtcgaatgggcaggtagccggatcaagcgtatgcagccgccgcattgcatcagccatgatggatacttt
ctcggcaggagcaaggtgagatgacaggagatcctgccccggcacttcgcccaatagcagccagtcccttcccgctt
cagtgacaacgtcgagcacagctgc
```

LacZ homolog sequence (SEQ ID NO:159)
```
cagacgatggtgcaggatatcctgctgatgaagcagaacaactttaacgccgtgcgctgttcgcattatc
```

LacI homolog sequence (SEQ ID NO:160)
```
atgtgaaaccagtaacgttatacgatgtcgcagagtatgccggtgtctcttatcagaccgtttcccgcgtggtgaac
caggccagccacgtttctgcgaaaacgcgggaaaaagtggaagcggcgatggcggagctgaattacattcccaaccg
cgtggcacaacaactggcgggcaaacagtcgttgctgattggcgttgccacctccagtctggccctgcacgcgccgt
cgcaaattgtcgcggcgattaaatctcgcgccgatcaactgggtgccagcgtggtggtcgatgtagaacgaagc
ggcgtcgaagcctgtaaagcggcggtgcacaatcttctcgcgcaacgcgtcagtgggctgatcattaactatccgct
ggatgaccaggatgccattgctgtggaagctgcctgcactaatgttccggcgttatttcttgatgtctctgaccaga
cacccatcaacagtattattttctcccatgaagacggtacgcgactgggcgtggagcatctggtcgcattgggtcac
cagcaaatcgcgctgttagcgggcccattaagttctgtctcggcgcgtctgcgtctggctggctggcataaatatct
cactcgcaatcaaattcagccgatagcggaacgggaaggcgactggagtgccatgtccggttttcaacaaaccatgc
aaatgctgaatgagggcatcgttcccactgcgatgctggttgccaacgatcagatggcgctgggcgcaatgcgcgcc
attaccgagtccgggctgcgcgttggtgcggatatctcggtagtgggatacgacgataccgaagacagctcatgtta
tatcccgccgttaaccaccatcaaacaggattttcgcctgctggggcaaaccagcgtggaccgcttgctgcaactct
ctcagggccaggcggtgaagggcaatcagctgttgcccgtctcactggtgaaaagaaaaaccaccctggcgcccaat
acgcaaaccgcctctccccgcgcgttggccgattcattaatgcagctggcacgacaggtttcccgactggaaagcgg
gcagtga
```

PRODUCTION OF FATTY ACID DERIVATIVES

CROSS-REFERENCE TO RELATED APPLICATIONS

This application claims the benefit of U.S. Provisional Application No. 61/245,943, filed Sep. 25, 2009, the contents of which are hereby incorporated in their entirety herein.

BACKGROUND OF THE INVENTION

Petroleum is a limited, natural resource found in the Earth in liquid, gaseous, or solid forms. Petroleum is primarily composed of hydrocarbons, which are comprised mainly of carbon and hydrogen. It also contains significant amounts of other elements, such as, nitrogen, oxygen, or sulfur, in different forms.

Petroleum is a valuable resource, but petroleum products are developed at considerable costs, both financial and environmental. First, sources of petroleum must be discovered. Petroleum exploration is an expensive and risky venture. The cost of exploring deep water wells can exceed $100 million. In addition to the economic cost, petroleum exploration carries a high environmental cost. For example, offshore exploration disturbs the surrounding marine environments.

After a productive well is discovered, the petroleum must be extracted from the Earth at great expense. Even under the best circumstances, only 50% of the petroleum in a well can be extracted. Petroleum extraction also carries an environmental cost. For example, petroleum extraction can result in large seepages of petroleum rising to the surface. Offshore drilling involves dredging the seabed which disrupts or destroys the surrounding marine environment.

After extraction, petroleum must be transported over great distances from petroleum producing regions to petroleum consuming regions. In addition to the shipping costs, there is also the environmental risk of devastating oil spills.

In its natural form, crude petroleum extracted from the Earth has few commercial uses. It is a mixture of hydrocarbons (e.g., paraffins (or alkanes), olefins (or alkenes), alkynes, napthenes (or cylcoalkanes), aliphatic compounds, aromatic compounds, etc.) of varying length and complexity. In addition, crude petroleum contains other organic compounds (e.g., organic compounds containing nitrogen, oxygen, sulfur, etc.) and impurities (e.g., sulfur, salt, acid, metals, etc.).

Hence, crude petroleum must be refined and purified before it can be used commercially. Due to its high energy density and its easy transportability, most petroleum is refined into fuels, such as transportation fuels (e.g., gasoline, diesel, aviation fuel, etc.), heating oil, liquefied petroleum gas, etc.

Crude petroleum is also a primary source of raw materials for producing petrochemicals. The two main classes of raw materials derived from petroleum are short chain olefins (e.g., ethylene and propylene) and aromatics (e.g., benzene and xylene isomers). These raw materials are derived from the longer chain hydrocarbons in crude petroleum by cracking the long chain hydrocarbons at considerable expense using a variety of methods, such as catalytic cracking, steam cracking, or catalytic reforming. These raw materials are used to make petrochemicals, which cannot be directly refined from crude petroleum, such as monomers, solvents, detergents, or adhesives.

One example of a raw material derived from crude petroleum is ethylene. Ethylene is used to produce petrochemicals such as, polyethylene, ethanol, ethylene oxide, ethylene glycol, polyester, glycol ether, ethoxylate, vinyl acetate, 1,2-dichloroethane, trichloroethylene, tetrachloroethylene, vinyl chloride, and polyvinyl chloride. Another example of a raw material derived from crude petroleum is propylene. Propylene is used to produce isopropyl alcohol, acrylonitrile, polypropylene, propylene oxide, propylene glycol, glycol ethers, butylene, isobutylene, 1,3-butadiene, synthetic elastomers, polyolefins, alpha-olefins, fatty alcohols, acrylic acid, acrylic polymers, allyl chloride, epichlorohydrin, and epoxy resins.

Petrochemicals can be used to make specialty chemicals, such as plastics, resins, fibers, elastomers, pharmaceuticals, lubricants, or gels. Examples of specialty chemicals which can be produced from petrochemical raw materials are: fatty acids, hydrocarbons (e.g., long chain hydrocarbons, branched chain hydrocarbons, saturated hydrocarbons, unsaturated hydrocarbons, etc.), fatty alcohols, esters, fatty aldehydes, ketones, lubricants, etc.

Specialty chemicals have many commercial uses. Fatty acids are used commercially as surfactants. Surfactants can be found in detergents and soaps. Fatty acids can also be used as additives in fuels, lubricating oils, paints, lacquers, candles, salad oils, shortenings, cosmetics, and emulsifiers. In addition, fatty acids are used as accelerator activators in rubber products. Fatty acids can also be used as a feedstock to produce methyl esters, amides, amines, acid chlorides, anhydrides, ketene dimers, and peroxy acids and esters.

Esters have many commercial uses. For example, biodiesel, an alternative fuel, is comprised of esters (e.g., fatty acid methyl ester, fatty acid ethyl esters, etc.). Some low molecular weight esters are volatile with a pleasant odor which makes them useful as fragrances or flavoring agents. In addition, esters are used as solvents for lacquers, paints, and varnishes. Furthermore, some naturally occurring substances, such as waxes, fats, and oils are comprised of esters. Esters are also used as softening agents in resins and plastics, plasticizers, flame retardants, and additives in gasoline and oil. In addition, esters can be used in the manufacture of polymers, films, textiles, dyes, and pharmaceuticals.

In addition, crude petroleum is a source of lubricants. Lubricants derived petroleum are typically composed of olefins, particularly polyolefins and alpha-olefins. Lubricants can either be refined from crude petroleum or manufactured using the raw materials refined from crude petroleum.

Obtaining these specialty chemicals from crude petroleum requires a significant financial investment as well as a great deal of energy. It is also an inefficient process because frequently the long chain hydrocarbons in crude petroleum are cracked to produce smaller monomers. These monomers are then used as the raw material to manufacture the more complex specialty chemicals.

In addition to the problems with exploring, extracting, transporting, and refining petroleum, petroleum is a limited and dwindling resource. One estimate of current world petroleum consumption is 30 billion barrels per year. By some estimates, it is predicted that at current production levels, the world's petroleum reserves could be depleted before the year 2050.

Finally, the burning of petroleum based fuels releases greenhouse gases (e.g., carbon dioxide) and other forms of air pollution (e.g., carbon monoxide, sulfur dioxide, etc.). As the world's demand for fuel increases, the emission of greenhouse gases and other forms of air pollution also increases. The accumulation of greenhouse gases in the atmosphere leads to an increase in global warming. Hence, in addition to damaging the environment locally (e.g., oil spills, dredging of marine environments, etc.), burning petroleum also damages the environment globally.

Due to the inherent challenges posed by petroleum, there is a need for a renewable petroleum source which does not need to be explored, extracted, transported over long distances, or substantially refined like petroleum. There is also a need for a renewable petroleum source that can be produced economically. In addition, there is a need for a renewable petroleum source that does not create the type of environmental damage produced by the petroleum industry and the burning of petroleum based fuels. For similar reasons, there is also a need for a renewable source of chemicals that are typically derived from petroleum.

Renewable energy sources, such as sunlight, water, wind, and biomass, are a potential alternative to petroleum fuels. Biofuel is a biodegradable, clean-burning combustible fuel produced from biomass, and can be made of alkanes and esters. An exemplary biofuel is biodiesel. Biodiesel can be used in most internal combustion diesel engines in either a pure form, which is referred to as "neat" biodiesel, or as a mixture in any concentration with regular petroleum diesel.

Biodiesel offers advantages compared to petroleum-based diesel, including reduced emissions (e.g., carbon monoxide, sulphur, aromatic hydrocarbons, soot particles) during combustion. Biodiesel also maintains a balanced carbon dioxide cycle because it is based on renewable biological materials. Biodiesel is typically biodegradable, and imparts enhanced safety due to its high flash point and low flammability. Furthermore, biodiesel provides good lubrication properties, thereby reducing wear and tear on engines.

Current methods of making biodiesel involve transesterification of triacylglycerides from vegetable oil feedstocks, such as rapeseed in Europe, soybean in North America, and palm oil in South East Asia. Industrial-scale biodiesel production is thus geographically and seasonally restricted to areas where vegetable oil feedstocks are produced. The transesterification process leads to a mixture of fatty esters which can be used as biodiesel. However, glycerin is an undesirable byproduct of the transesterification process. To be usable as biodiesel, the fatty esters must be further purified from the heterogeneous product. This increases costs and the amount of energy required for fatty ester production and, ultimately, biodiesel production as well. Furthermore, vegetable oil feedstocks are inefficient sources of energy because they require extensive acreage for cultivation. For example, the yield of biodiesel from rapeseed is only 1300 L/hectare because only the seed oil is used for biodiesel production, while the rest of the rapeseed biomass is discarded. Additionally, cultivating some vegetable oil feedsocks, such as rapeseed and soybean, requires frequent crop rotation to prevent nutrient depletion of the land.

Thus there is a need for an economically- and energy-efficient biofuel, and methods of making biofuels from renewable energy sources such as biomass.

SUMMARY OF THE INVENTION

This disclosure relates to the production of fatty acids and derivatives thereof including, for example, fatty esters from genetically engineered microorganisms. Examples of fatty esters include fatty acid esters, such as those derived from short-chain alcohols, including fatty acid ethyl esters ("FAEE") and fatty acid methyl esters ("FAME"), and those derived from long-chain fatty alcohols. The fatty acids and/or fatty acid derivatives that are produced can be used, individually or in suitable combinations, as a biofuel (e.g., a biodiesel), an industrial chemical, or a component of, or feedstock for, a biofuel or an industrial chemical. In some aspects, the invention pertains to a method of producing one or more free fatty acids and/or one or more fatty acid derivatives such as fatty acid esters, including, for example, FAEE, FAME and/or other fatty acid ester derivatives of longer-chain alcohols. In related aspects, the method comprises providing a genetically engineered production host suitable for making fatty acids and fatty acid derivatives.

Accordingly, in one aspect, the invention features a method of making a fatty acid or a fatty acid derivative such as a fatty ester. The method includes expressing in a host cell a gene encoding an ester synthase. In some embodiments, the gene encoding an ester synthase is selected from the enzymes classified as EC 2.3.1.75, and any other polypeptides capable of catalyzing the conversion of an acyl thioester to fatty esters, including, without limitation, wax-ester synthases, acyl-CoA:alcohol transacylases, alcohol O-fatty acid-acyl-transferase, acyltransferases, and fatty acyl-coA:fatty alcohol acyltransferases, or a suitable variant thereof. In other embodiments, the ester synthase gene is one that encodes wax/dgat, a bifunctional ester synthase/acyl-CoA: diacylglycerol acyltransferase from *Simmondsia chinensis, Acinetobacter* sp. ADP1, *Alcanivorax borkumensis, Pseudomonas aeruginosa, Fundibacter jadensis, Arabidopsis thaliana,* or *Alkaligenes eutrophus*. In some embodiments, the gene encoding an ester synthase is selected from the group consisting of: AtfA1 (an ester synthase derived from *Alcanivorax borkumensis* SK2, GenBank Accession No. YP_694462), AtfA2 (another ester synthase derived from *Alcanivorax borkumensis* SK2, GenBank Accession No. YP_693524), ES9 (an ester synthase from *Marinobacter hydrocarbonoclasticus* DSM 8798, GenBank Accession No. ABO21021), ES8 (another ester synthase derived from *Marinobacter hydrocarbonoclasticus* DSM 8798, GenBank Accession No. ABO21020), and variants thereof. In a particular embodiment, the gene encoding the ester synthase or a suitable variant is overexpressed.

In another aspect, the invention features a method of making a fatty acid derivative, for example, a fatty ester, the method comprising expressing in a host cell a gene encoding an ester synthase polypeptide comprising the amino acid sequence of SEQ ID NO:18, 24, 25, or 26, or a variant thereof. In certain embodiments, the polypeptide has ester synthase and/or acyltransferase activity. In some embodiments, the polypeptide has the capacity to catalyse the conversion of a thioester to a fatty acid and/or a fatty acid derivative such as a fatty ester. In a particular embodiment, the polypeptide has the capacity to catalyze the conversion of a fatty acyl-CoA and/or a fatty acyl-ACP to a fatty acid and/or a fatty acid derivative such as a fatty ester, using an alcohol as substrate. In alternative embodiments, the polypeptide has the capacity to catalyze the conversion of a free fatty acid to a fatty ester, using an alcohol as substrate.

In certain embodiments, an endogenous thioesterase of the host cell, if present, is unmodified. In certain other embodiments, the host cell expresses an attenuated level of a thioesterase activity or the thioesterase is functionally deleted. In some embodiments, the host cell has no detectable thioesterase activity. As used herein the term "detectable" means capable of having an existence or presence ascertained. For example, production of a product from a reactant (e.g., production of a certain type of fatty acid esters) is desirably detectable using the methods provided herein. In certain embodiments, the host cell expresses an attenuated level of a fatty acid degradation enzyme, such as, for example, an acyl-CoA synthase, or the fatty acid degradation enzyme is functionally deleted. In some embodiments, the host cell has no detectable fatty acid degradation enzyme activity. In particular embodiments, the host cell expresses an attenuated level of a thioesterease, a fatty acid degradation enzyme, or both. In other embodiments, the thioesterase, the fatty acid degradation enzyme, or both, are functionally deleted. In some embodiments, the host cell has no detectable thioesterase activity, acyl-CoA synthase activity, or neither. In some embodiments, the host cell can convert an acyl-ACP or acyl-CoA into fatty acids and/or derivatives thereof such as esters, in the absence of a thioesterase, a fatty acid derivative enzyme, or both. Alternatively, the host cell can convert a free fatty acid to a fatty ester in the absence of a thioesterase, a fatty acid derivative enzyme, or both. In certain embodiments, the method further includes isolating the fatty acids or derivatives thereof from the host cell.

In certain embodiments, the fatty acid derivative is a fatty ester. In certain embodiments, the fatty acid or fatty acid derivative is derived from a suitable alcohol substrate such as a short- or long-chain alcohol. In some embodiments, the fatty acid or fatty acid derivative is present in the extracellular environment. In certain embodiments, the fatty acid or fatty acid derivative is isolated from the extracellular environment of the host cell. In some embodiments, the fatty acid or fatty acid derivative is spontaneously secreted, partially or completely, from the host cell. In alternative embodiments, the fatty acid or derivative is transported into the extracellular environment, optionally with the aid of one or more transport proteins. In other embodiments, the fatty acid or fatty acid derivative is passively transported into the extracellular environment.

In another aspect, the invention features an in vitro method of producing a fatty acid and/or a fatty acid derivative extracellulary comprising providing a substrate and a purified ester synthase comprising the amino acid sequence of SEQ ID NO:18, 24, 25, or 26, or a variant thereof. In some embodiments, the method comprising culturing a host cell under conditions that allow expression or overexpression of an ester synthase polypeptide or a variant thereof, and isolating the ester synthase from the cell. In some embodiments, the method further comprising contacting a suitable substrate such with the cell-free extract under conditions that permit production of a fatty acid and/or a fatty acid derivative.

In some embodiments, the ester synthase polypeptide comprises the amino acid sequence of SEQ ID NO:18, 24, 25, or 26, with one or more amino acid substitutions, additions, insertions, or deletions, and the polypeptide has ester synthase and/or acyltransferase activity. In certain embodimens, the ester synthase polypeptide has increased ester synthase and/or transferase activity. For example, the ester synthase polypeptide is capable, or has an improved capacity, of catalyzing the conversion of thioesters, for example, fatty acyl-CoAs or fatty acyl-ACPs, to fatty acids and/or fatty acid derivatives. In particular embodiments, the ester synthase polypeptide is capable, or has an improved capacity, of catalyzing the conversion of thioester substrates to fatty acids and/or derivatives thereof, such as fatty esters, in the absence of a thioesterase activity, a fatty acid degradation enzyme activity, or both. For example, the polypeptide converts fatty acyl-ACP and/or fatty acyl-CoA into fatty esters in vivo, in the absence of a thioesterase or an acyl-CoA synthase activity. In alternative embodiments, the polypeptide is capable of catalyzing the conversion of a free fatty acid to a fatty ester, in the absence of a thioesterase activity, a fatty acid degradation enzyme activity, or both. For example, the polypeptide can convert a free fatty acid into a fatty ester in vivo or in vitro, in the absence of a thioesterase activity, an acyl-CoA synthase activity, or both.

In some embodiments, the ester synthase polypeptide is a variant comprising the amino acid sequence of SEQ ID NO:18, 24, 25, or 26, with one or more non-conserved amino acid substitutions, wherein the ester synthase polypeptide has ester synthase and/or acyltransferase activity. In certain embodiments, the ester synthase polypeptide has improved ester synthase and/or acyltransferase activity. For example, a glycine residue at position 395 of SEQ ID NO:18 can be substituted with a basic amino acid residue, such that the resulting ester synthase variant retains or has improved ester synthase and/or acyltransferase activity. In an exemplary embodiment, the glycine residue at position 395 of SEQ ID NO:18 is substituted with an arginine or a lysine residue, wherein the resulting ester synthase variant retains or has improved capacity to catalyze the conversion of a thioester into a fatty acid and/or a fatty acid derivative such as a fatty ester.

In some embodiments, the ester synthase variant comprises one or more of the following conserved amino acid substitutions: replacement of an aliphatic amino acid, such as alanine, valine, leucine, and isoleucine, with another aliphatic amino acid; replacement of a serine with a threonine; replacement of a threonine with a serine; replacement of an acidic residue, such as aspartic acid and glutamic acid, with another acidic residue; replacement of residue bearing an amide group; exchange of a basic residue, such as lysine and arginine, with another basic residue; and replacement of an aromatic residue, such as phenylalanine and tyrosine, with another aromatic residue. In some embodiments, the ester synthase variant has about 1, 2, 3, 4, 5, 6, 7, 8, 9, 10, 15, 20, 30, 40, 50, 60, 70, 80, 90, 100, or more amino acid substitutions, additions, insertions, or deletions. In some embodiments, the polypeptide variant has ester synthase and/or acyltransferase activity. For example, the ester synthase polypeptide is capable of catalyzing the conversion of thioesters to fatty acids and/or fatty acid derivatives, using alcohols as substrates. In a non-limiting example, the polypeptide is capable of catalyzing the conversion of a fatty acyl-CoA and/or a fatty acyl-ACP to a fatty acid and/or a fatty acid ester, using a suitable alcohol substrate, such as, for instance, a methanol, ethanol, propanol, butanol, pentanol, hexanol, heptanol, octanol, decanol, dodecanol, tetradecanol, or hexadecanol. In another non-limiting example, the ester synthase polypeptide is capable of catalyzing the conversion of a fatty acyl-ACP and/or a fatty acyl-CoA to a fatty acid and/or a fatty acid ester, in the absence of a thioesterase, a fatty acid degradation enzyme, or both. In a further embodiment, the polypeptide is capable of catalyzing the conversion of a free fatty acid into a fatty ester in the absence of a thioesterase, a fatty acid degradation enzyme, or both.

In some embodiments, the ester synthase polypeptide is about 200 amino acids to about 2,000 amino acids in length, for example, from about 250 to about 1,500 amino acid residues in length, from about 300 to about 1,200 amino acid residues in length, from about 350 to about 1,000 amino acid residues in length, from about 400 to about 800 amino acid residues in length, or from about 450 to about 600 amino acid residues in length. In certain embodiments, the ester synthase polypeptide is about 300 amino acid residues in length or longer, for example, about 400 amino acid residues in length or longer, or about 450 amino acid residues in length or longer. In certain related embodiments, the ester synthase polypeptide is about 1,000 amino acid residues in length or shorter, for example, about 800 amino acid residues in length or shorter, about 700 amino acid residues in length or shorter, or about 600 amino acid residues in length or shorter. An exemplary ester synthase of the invention is about 500 amino acid residues in length.

In some embodiments, the method further includes modifying the expression of a gene encoding an ester synthase in the host cell. In certain embodiments, modifying the expression of a gene encoding an ester synthase includes expressing a heterologous gene encoding an ester synthase in the host cell and/or otherwise increasing the expression or activity of an endogenous ester synthase in the host cell.

In certain embodiments, an endogenous thioesterase enzyme of the host cell, if present, is unmodified. In other embodiments, the method includes modifying the expression of a gene encoding a thioesterase in the host cell. In certain embodiments, modifying the expression of a gene encoding a thioesterase includes expressing a heterologous gene encoding a thioesterase in the host cell and/or increasing the expression and/or activity of an endogenous thioesterase in the host cell. In alternate embodiments, modifying the expression of a gene encoding a thioesterase includes attenuating the expression of an endogenous gene encoding a thioesterase in the host cell, and/or decreasing the expression and/or activity of an endogenous thioesterase in the host cell. In certain embodiments, modifying the expression of a thioesterase in the host cell comprises functionally deleting an endogenous gene encoding a thioesterase. In some embodiments, there is no detectable thioesterase activity in the host cell. In particular embodiments, the thioesterase is encoded by tesA, tesA without leader sequence, tesB, fatB, fatB2, fatB3, fatA, or fatA1.

Thioesterase activity can be determined or measured using various known in vitro or in vivo assays, including without limitation an acyl-CoA hydrolysis assay, which measures the rate of cleavage of an acyl-CoA substrate using a DTNB (5,5'-Dithio-bis(2-nitro-benzoic acid)) reaction and monitors the changes of absorbance at 412 nm and a molar extinction coefficient of 13,600 $M^{-1}cm^{-1}$. It is known in the art that various ester synthases can have overlapping thioesterase activities. As used herein, however, the term "ester synthase" does not comprise enzymes that also have thioesterase activity. The ones that have both ester synthase activity and thioesterase activity are categorized as thioesterases herein.

In another aspect, the invention features a method of making fatty acids and/or fatty acid derivatives, for example, a fatty ester, comprising expressing in a host cell a gene encoding an ester synthase, in the absence of a thioesterase or a thioesterase activity in the host cell. In certain embodiments, the host cell is genetically engineered to express an attenuated level of a fatty acid degradation enzyme relative to its level in a wild type host cell. Examples of fatty acid degradation enzymes include, without limitation, an acyl-CoA synthase of EC 2.3.1.86 or EC 6.2.1.3. Examples of host cells from which the fatty acid degradation enzyme can be found include *Saccharomyces cerevisiae, Candida lipolytica, Escherichia coli, Arthrobacter, Rhodotorula glutinins, Acinetobacter, Candida lipolytica, Botryococcus braunii, Vibrio furnissii, Vibrio harveyi, Micrococcus leuteus, Stenotrophomonas maltophi$l^{a}$*, or *Bacillus subtilis*. In some embodiments, the host cell is genetically engineered to express an attenuated level of an acyl-CoA synthase relative to a wild type host cell. In particular embodiments, the host cell expresses an attenuated level of an acyl-CoA synthase encoded by fadD, fadK, BH3103, yhfL, Pfl-4354, EAV15023, fadD1, fadD2, RPC_4074, fadDD35, fadDD22, faa3p or the gene encoding the protein ZP_01644857. In certain embodiments, the fatty acid degradation enzyme, such as the acyl-CoA synthase gene, is functionally deleted such that the host cell has no detectable acyl-CoA synthase activity.

In certain embodiments, an endogenous thioesterase enzyme of the host cell, if present, is unmodified. In other embodiments, the host cell is genetically engineered to express an attenuated level of a thioesterase, an attenuated level of a fatty acid degradation enzyme, or both. In some embodiments, a thioesterase, a fatty acid degradation enzyme, or both, are functionally deleted. In some embodiments, the host cell has no detectable thioesterase activity, acyl-CoA synthase activity or neither. In some embodiments, the host cell can produce fatty acids and/or derivatives from thioester and alcohol substrates. In alternative embodiments, the host cell can produce fatty esters from free fatty acids and alcohol substrates.

In some embodiments, the ester synthase polypeptide is derived from, for example, a bacterium, plant, insect, yeast, fungus, or mammal. In certain embodiments, the ester synthase polypeptide is from a mammalian cell, a plant cell, an insect cell, a fungus cell, a filamentous fungi cell, a bacterial cell, a cyanobacterial cell, or a cell of any other organism described herein. In certain embodiments, the naturally-occurring ester synthase is from *Acidobacteria, Acidothermus, Acinetobacter, Aeromonas, Alcanivorax, Alcaligenes, Alteromonas, Anaeromyxobacter, Arabidopsis, Bradyrhizobium, Erythrobacter, Frankia, Fundibacter, Hahella chejuensis, Janibacter, Limnobacter, Marinobacter, Methylibium, Microscilla, Moritella, Mus musculus, Mycobacterium, Myxococcus, Natronomonas, Nocardia, Nocardioides, Photobacterium, Proteobacterium, Plesiocystis, Polaromonas, Pseudomonas, Psychrobacter, Reinekea, Rhodoferax, Rhodococcus, Roseiflexus, Saccharopolyspora, Salinibacter, Simmodsia Solibacter, Sphingopyxis, Stigmatella, Streptomyces, Tenacibaculum*, or *Ustilago*.

In particular embodiments, the naturally-occurring ester synthase of the invention is derived from any one of *Acidobacteria bacterium, Acidothermus cellulolyticus, Acinetobacter baumannii, Acinetobacter baylyi, Acinetobacter sp., Aeromonas hydrophila, Aeromonas salmonicida, Alcaligenes europhus, Alcanivorax borkumensis, Alcanivorax jadensis, Alteromonas macleodii, Anaeromyxobacter dehalogenans, Anaeromyxobacter sp., Arabidopsis thaliana, Bradyrhizobium japonicum, Cryptococcus curvatus, Erythrobacter litoralis, Erythrobacter sp., Frankia sp., Fundibacter jadensis, gamma proteobacterium, Hahella chejuensis, Homo sapiens, Janibacter sp., Limnobacter sp., marine gamma proteobacterium, Marinobacter algicola, Marinobacter aquaeolei, Marinobacter hydrocarbinoclasticus, Marinobacter sp., Methylibium petroleiphilum, Microscilla marina, Moritella sp., Mortierella alpina, Mus musculus, Mycobacterium abscessus, Mycobacterium avium, Mycobacterium bovis, Mycobacterium gilvum, Mycobacterium leprae, Mycobacterium marinum, Mycobacterium smegmatis, Mycobacterium sp., Mycobacterium tuberculosis, Mycobacterium ulcerans, Mycobacterium vanbaalenii, Myxococcus xanthus, Natronomonas pharaonis, Nocardia farcinica, Nocardioides sp., Photobacterium profundum, Plesiocystis pacifica, Polaromonas naphthalenivorans, Polaromonas sp., Psudomonas aeruginosa, Psychrobacter arcticus, Psychrobacter cryohalolentis, Psychrobacter sp., Reinekea sp., Rhodococcus opacus, Rhodoferax ferrireducens, Rhodococcus sp., Rhodoferax ferrireducens, Roseiflexus sp., Roseiflexus castenholzii, Saccharomyces cerevisiae, Saccharopolyspora erythraea, Salinibacter ruber, Simmodsia chinensis, Solibacter usitatus, Sphingopyxis alaskensis, Stigmatella aurantiaca, Streptomyces avermitilis, Streptomyces coelicolor, Strepto-*

*myces griseus, Tenacibaculum* sp., and *Ustilago maydis*. In particular embodiments, the gene encoding the ester synthase or a variant thereof is overexpressed.

In other embodiments, the host cell is genetically engineered to express, relative to a wild type host cell, a decreased level of at least one of a gene encoding an acyl-CoA dehydrogenase, a gene encoding an outer membrane protein receptor, and a gene encoding a transcriptional regulator of fatty acid biosynthesis. In certain embodiments, one or more of a gene encoding an acyl-CoA dehydrogenase, a gene encoding an outer membrane protein receptor, a gene encoding a transcriptional regulator of fatty acid biosynthesis are functionally deleted. In certain embodiments, the host cell expressing a decreased level of an outer membrane protein receptor is resistant to phage infection. In some embodiments, the gene encoding an acyl-CoA dehydrogenase is fadE. In some embodiments, the gene encoding an outer membrane protein receptor is one that encodes a receptor for ferrichrome, colicin M, phage T1, phage T5, or phage phi80. Host cells comprising such an outer membrane protein receptor include, for example, *Saccharomyces cerevisiae, Candida lipolytica, Escherichia coli, Arthrobacter, Rhodotorula glutinins, Acinetobacter, Candida lipolytica, Botryococcus braunii, Vibrio furnissii, Vibrio harveyi, Micrococcus leuteus, Stenotrophomonas maltophila,* or *Bacillus subtilis*. In certain embodiments, the gene encoding an outer membrane protein receptor is fhuA (also known as tonA). In yet other embodiments, the gene encoding a transcriptional regulator of fatty acid biosynthesis is fabR.

In certain embodiments, the method further includes culturing the host cell in the presence of at least one biological substrate for the ester synthase polypeptide. In some embodiments, the method includes culturing the host cell under conditions that allow the expression or overexpression of the ester synthase enzyme or a suitable variant thereof. In further embodiments, the method includes culturing the host cell under conditions that permit production of fatty acids or derivatives thereof via an enzymatic reaction catalyzed by the ester synthase or a variant thereof, without the participation of a thioesterase, a fatty acid degradation enzyme, or both. In certain embodiments, the biological substrate for the ester synthase polypeptide is a thioester. In other embodiments, the biological substrate is an alcohol, such as, for example, short-chain or long-chain fatty alcohols. In yet another embodiment, the biological substrate is a free fatty acid.

In another aspect, the invention features a method of producing a fatty acid and/or fatty acid derivative, including, for example, a fatty acid ester. The method includes expressing in a host cell a gene encoding an ester synthase or a variant thereof comprising an amino acid sequence having at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% sequence identity to the amino acid sequence of SEQ ID NO:18, 24, 25, or 26. In some embodiments, the ester synthase has the amino acid sequence of SEQ ID NO:18, 24, 25 or 26.

In some embodiments, the method further includes isolating the fatty acid or fatty acid derivative from the genetically engineered host cell. In some embodiments, the fatty acid or fatty acid derivative is present in the extracellular environment. In certain embodiments, the fatty acid or fatty acid derivative is isolated from the extracellular environment of the host cell. In certain embodiments, the fatty acid or fatty acid derivative is spontaneously secreted into the extracellular environment, partially or completely. In some embodiments, the fatty acid or fatty acid derivative is transported into the extracellular environment, with or without the aid of one or more suitable transport proteins. In other embodiments, the fatty acid or fatty acid derivative is passively transported into the extracellular environment.

In certain embodiments, an endogenous thioesterase enzyme of the host cell, if present, is unmodified. In certain embodiments, the method includes modifying the expression of a gene encoding a thioesterase in the host cell. In some embodiments, modifying the expression of a gene encoding a thioesterase includes expressing a heterologous gene encoding a thioesterase in the host cell and/or increasing the expression or activity of an endogenous thioesterase in the host cell. In alternate embodiments, modifying the expression of a gene encoding a thioesterase includes attenuating the expression of an endogenous gene encoding a thioesterase in the host cell. In some embodiments, modifying the expression of a gene encoding a thioesterase includes functionally deleting an endogenous gene encoding a thioesterase. In particular embodiments, the thioesterase is encoded by tesA, tesA without leader sequence, tesB, fatB, fatB2, fatB3, fatA, or fatA1.

In some embodiments, the host cell is genetically engineered to express an attenuated level of a fatty acid degradation enzyme relative to its level in a wild type host cell. Exemplary fatty acid degradation enzymes include, without limitation, acyl-CoA synthase enzymes of EC 2.3.1.86 or EC 6.2.1.3. In particular embodiments, the host cell expresses an attenuated level of an acyl-CoA synthase encoded by fadD, fadK, BH3103, yhfL, Pfl-4354, EAV15023, fadD1, fadD2, RPC_4074, fadDD35, fadDD22, faa3p or the gene encoding the protein ZP_01644857. In certain embodiments, the above-described fatty acid degradation enzyme such as, for example, an acyl-CoA synthase, is functionally deleted such that the host cell does not have detectable acyl-CoA synthase activity.

In certain embodiments, the host cell is genetically engineered to express an attenuated level of a thioesterease, an attenuated level of a fatty acid degradation enzyme, or both. In some embodimens, a thioesterase, an acyl-CoA synthase, or both, are functionally deleted. In some embodiments, the host cell has no detectable thioesterase activity or fatty acid degradation enzyme activity. In some embodiments, the host cell is capable of producing fatty acids and/or derivatives thereof.

In other embodiments, the host cell is genetically engineered to express, relative to a wild type host cell, a decreased level of at least one of a gene encoding an acyl-CoA dehydrogenase, a gene encoding an outer membrane protein receptor, and a gene encoding a transcriptional regulator of fatty acid biosynthesis. In some embodiments, one or more of a gene encoding an acyl-CoA dehydrogenase, a gene encoding an outer membrane protein receptor, and a gene encoding a transcriptional regulator of fatty acid biosynthesis are functionally deleted. In some embodiments, the gene encoding an acyl-CoA dehydrogenase is fadE. In some embodiments, the gene encoding an outer membrane protein receptor is one that encodes a receptor for ferrichrome, colicin M, phage T1, phage T5, or phage phi80. In certain embodiments, the gene encoding an outer membrane receptor is fhuA (also known as tonA). In yet other embodiments, the gene encoding a transcriptional regulator of fatty acid biosynthesis is fabR.

In some embodiments, the ester synthase polypeptide is derived from a bacterium, plant, insect, yeast, fungus, or mammal. In certain embodiments, the polypeptide is from a mammalian cell, plant cell, insect cell, yeast cell, fungus cell, filamentous fungi cell, bacterial cell, or a cell of any other organism described herein. In certain embodiments, the ester synthase is from *Acidobacteria, Acidothermus, Acinetobacter, Aeromonas, Alcanivorax, Alcaligenes, Alteromonas, Anaeromyxobacter, Arabidopsis, Bradyrhizobium, Erythrobacter, Frankia, Fundibacter, Hahella chejuensis, Janibacter, Limnobacter, Marinobacter, Methylibium, Microscilla, Moritella, Mus musculus, Mycobacterium, Myxococcus, Natronomonas, Nocardia, Nocardioides, Photobacterium, Proteobacterium, Plesiocystis, Polaromonas, Pseudomonas, Psychrobacter, Reinekea, Rhodoferax, Rhodococcus, Roseiflexus, Saccharopolyspora, Salinibacter, Simmodsia Solibacter, Sphingopyxis, Stigmatella, Streptomyces, Tenacibaculum*, or *Ustilago*.

In a particular embodiment, the ester synthase is derived from any one of *Acidobacteria bacterium, Acidothermus cellulolyticus, Acinetobacter baumannii, Acinetobacter baylyi, Acinetobacter sp., Aeromonas hydrophila, Aeromonas salmonicida, Alcaligenes eurphus, Alcanivorax borkumensis, Alcanivorax jadensis, Alteromonas macleodii, Anaeromyxobacter dehalogenans, Anaeromyxobacter sp., Arabidopsis thaliana, Bradyrhizobium japonicum, Cryptococcus curvatus, Erythrobacter litoralis, Erythrobacter sp., Frankia sp., Fundibacter jadensis, gamma proteobacterium, Hahella chejuensis, Homo sapiens, Janibacter sp., Limnobacter sp., marine gamma proteobacterium, Marinobacter algicola, Marinobacter aquaeolei, Marinobacter hydrocarbinoclasticus, Marinobacter sp., Methylibium petroleiphilum, Microscilla marina, Moritella sp., Mortierella alpina, Mus musculus, Mycobacterium abscessus, Mycobacterium avium, Mycobacterium bovis, Mycobacterium gilvum, Mycobacterium leprae, Mycobacterium marinum, Mycobacterium smegmatis, Mycobacterium sp., Mycobacterium tuberculosis, Mycobacterium ulcerans, Mycobacterium vanbaalenii, Myxococcus xanthus, Natronomonas pharaonis, Nocardia farcinica, Nocardioides sp., Photobacterium profundum, Plesiocystis pacifica, Polaromonas naphthalenivorans, Polaromonas sp., Psudomonas aeruginosa, Psychrobacter arcticus, Psychrobacter cryohalolentis, Psychrobacter sp., Reinekea sp., Rhodococcus opacus, Rhodoferax ferrireducens, Rhodococcus sp., Rhodoferax ferrireducens, Roseiflexus sp., Roseiflexus castenholzii, Saccharomyces cerevisiae, Saccharopolyspora erythraea, Salinibacter ruber, Simmodsia chinensis, Solibacter usitatus, Sphingopyxis alaskensis, Stigmatella aurantiaca, Streptomyces avermitilis, Streptomyces coelicolor, Streptomyces griseus, Tenacibaculum sp.*, and *Ustilago maydis*. In particular embodiments, the gene encoding the ester synthase or a variant thereof is overexpressed.

In some embodiments, the method further includes culturing the host cell in the presence of at least one biological substrate for the ester synthase polypeptide. In certain embodiments, the method includes culturing the host cell under conditions sufficient to allow expression or overexpression of an ester synthase in the host cell. In certain embodiments, an endogenous thioesterase of the host cell, if present, is unmodified. In other embodiments, the host cell expresses an attenuated level of a thioesterase, a fatty acid degradation enzyme, or both. In some embodiments, the thioesterase, the fatty acid degradation enzyme, or both, are functionally deleted. In some embodiments, the host cell has no detectable thioesterase activity, acyl-CoA synthase activity, or neither activity. In some embodiments, the method includes culturing the host cells under conditions sufficient to permit production of fatty acids and/or fatty acid derivatives. In certain embodiments, the host cell is cultured in the presence of thioester substrates. In other embodiments, the host cell is cultured in the presence of an alcohol. In yet another embodiment, the host cell is cultured in the presence of a free fatty acid.

In another aspect, the invention features a method of producing a fatty acid and/or a fatty acid derivative such as, for example, a fatty ester. The method comprises expressing in a host cell a polynucleotide that that hybridizes to a complement of a nucleotide sequence SEQ ID NO:27, 28, 29, or 30, or to a fragment thereof, wherein the polynucleotide encodes a polypeptide having ester synthase and/or acyltransferase activity. For example, the polypeptide is capable catalyzing the conversion of thioesters to fatty acids and/or fatty acid derivatives such as fatty esters, using one or more alcohols as substrates. In a particular embodiment, suitable thioester substrates include acyl-CoAs, such as, for example, fatty acyl-CoAs, and acyl-ACPs, such as, for example, fatty acyl-ACPs. Suitable alcohol substrates include, for example, short or long chain alcohols, such as methanol, ethanol, propanol, butanol, pentanol, hexanol, octanol, heptanol, decanol, dodecanol, tetradecanol, or hexadecanol. In some embodiments, the polypeotide is capable of catalyzing the conversion of a free fatty acid to a fatty esters.

In some embodiments, the polynucleotide hybridizes under low stringency, medium stringency, high stringency, or very high stringency conditions, to a complement of the nucleotide sequence of SEQ ID NO:27, 28, 29, or 30, or to a fragment thereof. In certain embodiments, the polynucleotide comprises a sequence that has been codon-optimized for expression or overexpression in a selected host cell.

In some embodiments, the method further comprises isolating the fatty acid or fatty acid derivative from the host cell. In some embodiments, the fatty acid or fatty acid derivative is present in the extracellular environment. In certain embodiments, the fatty acid or fatty acid derivative is isolated from the extracellular environment of the host cell. In some embodiments, the fatty acid or fatty acid derivative is spontaneously secreted, partially or completely, from the host cell. In alternative embodiments, the fatty acid or fatty acid derivative is transported into the extracellular environment with or without the aid of one or more transport proteins. In other embodiments, the fatty acid or fatty acid derivative is passively transported into the extracellular environment.

In certain embodiments, an endogenous thioesterease of the host cell, if present, is unmodified. In certain other embodiments, the method includes modifying the expression of a gene encoding a thioesterase in the host cell. In certain embodiments, modifying the expression of a gene encoding a thioesterase includes expressing a heterologous gene encoding a thioesterase in the host cell and/or increasing the expression or activity of an endogenous thioesterase in the host cell. In alternate embodiments, modifying the expression of a gene encoding a thioesterase includes attenuating the expression of an endogenous gene encoding a thioesterase in the host cell and/or functionally deleting an endogenous thioesterase. In particular embodiments, the thioesterase is encoded by tesA, tesA without leader sequence, tesB, fatB, fatB2, fatB3, fatA, or fatA1.

In some embodiments, the host cell is genetically engineered to express an attenuated level of a fatty acid degradation enzyme relative to its level in a wild type host cell. Exemplary fatty acid degradation enzymes include, without limitation, acyl-CoA synthase enzymes of EC 2.3.1.86 or EC 6.2.1.3. In particular embodiments, the host cell expresses an attenuated level of an acyl-CoA synthase encoded by fadD, fadK, BH3103, yhfL, pfl-4354, eav15023, fadD1, fadD2, rpc_4074, fadDD35, fadDD22, faa3p or the gene encoding the protein ZP_01644857. In certain embodiments, the aforementioned fatty acid degradation enzyme, such as the acyl-CoA synthase gene, is functionally deleted such that the host cell does not have a detectable acyl-CoA synthase activity.

In some embodiments, the host cell is genetically engineered to express an attenuated level of a thioesterase, an attenuated level of a fatty acid degradation enzyme, or both. In some embodiments, a thioesterase, a fatty acid degradation enzyme, or both, are functionally delted. In certain embodiments, the host cell has no detectable thioesterase activity or fatty acid degradation enzyme activity. In some embodiments, the host cell is capable of producing fatty acids and/or derivatives thereof.

In other embodiments, the host cell is genetically engineered to express, relative to a wild type host cell, a decreased level of at least one of a gene encoding an acyl-CoA dehydrogenase, a gene encoding an outer membrane protein receptor, and a gene encoding a transcriptional regulator of fatty acid biosynthesis. In other embodiments, one or more of a gene encoding an acyl-CoA dehydrogenase, a gene encoding an outer membrane protein receptor, and a gene encoding a transcriptional regulator of fatty acid biosynthesis are functionally deleted. In some embodiments, the gene encoding an acyl-CoA dehydrogenase is fadE. In some embodiments, the gene encoding an outer membrane protein receptor is one that encodes a receptor for ferrichrome, colicin M, phage T1, phage T5, or phage phi80. In certain embodiments, the gene encoding an outer membrane protein receptor is fhuA (also known as tonA). In yet other embodiments, the gene encoding a transcriptional regulator of fatty acid biosynthesis is fabR.

In some embodiments, the ester synthase is derived from a bacterium, plant, insect, yeast, fungus, or mammal. In certain embodiments, the ester synthase polynucleotide is from a mammalian cell, plant cell, insect cell, yeast cell, fungus cell, filamentous fungi cell, bacterial cell, or a cell of any other organism described herein. In certain embodiments, the polynucleotide is from *Acidobacteria, Acidothermus, Acinetobacter, Aeromonas, Alcanivorax, Alcaligenes, Alteromonas, Anaeromyxobacter, Arabidopsis, Bradyrhizobium, Erythrobacter, Frankia, Fundibacter, Hahella chejuensis, Janibacter, Limnobacter, Marinobacter, Methylibium, Microscilla, Moritella, Mus musculus, Mycobacterium, Myxococcus, Natronomonas, Nocardia, Nocardioides, Photobacterium, Proteobacterium, Plesiocystis, Polaromonas, Pseudomonas, Psychrobacter, Reinekea, Rhodoferax, Rhodococcus, Roseiflexus, Saccharopolyspora, Salinibacter, Simmodsia Solibacter, Sphingopyxis, Stigmatella, Streptomyces, Tenacibaculum,* or *Ustilago.*

In a particular embodiment, the ester synthase polynucleotide is derived from any one of *Acidobacteria bacterium, Acidothermus cellulolyticus, Acinetobacter baumannii, Acinetobacter baylyi, Acinetobacter* sp., *Aeromonas hydrophila, Aeromonas salmonicida, Alcaligenes europhus, Alcanivorax borkumensis, Alcanivorax jadensis, Alteromonas macleodii, Anaeromyxobacter dehalogenans, Anaeromyxobacter* sp., *Arabidopsis thaliana, Bradyrhizobium japonicum, Cryptococcus curvatus, Erythrobacter litoralis, Erythrobacter* sp., *Frankia* sp., *Fundibacter jadensis, gamma proteobacterium, Hahella chejuensis, Homo sapiens, Janibacter* sp., *Limnobacter* sp., *marine gamma proteobacterium, Marinobacter algicola, Marinobacter aquaeolei, Marinobacter hydrocarbinoclasticus, Marinobacter* sp., *Methylibium petroleiphilum, Microscilla marina, Moritella* sp., *Mortierella alpina, Mus musculus, Mycobacterium abscessus, Mycobacterium avium, Mycobacterium bovis, Mycobacterium gilvum, Mycobacterium leprae, Mycobacterium marinum, Mycobacterium smegmatis, Mycobacterium* sp., *Mycobacterium tuberculosis, Mycobacterium ulcerans, Mycobacterium vanbaalenii, Myxococcus xanthus, Natronomonas pharaonis, Nocardia farcinica, Nocardioides* sp., *Photobacterium profundum, Plesiocystis pacifica, Polaromonas naphthalenivorans, Polaromonas* sp., *Psudomonas aeruginosa, Psychrobacter arcticus, Psychrobacter cryohalolentis, Psychrobacter* sp., *Reinekea* sp., *Rhodococcus opacus, Rhodoferax ferrireducens, Rhodococcus* sp., *Rhodoferax ferrireducens, Roseiflexus* sp., *Roseiflexus castenholzii, Saccharomyces cerevisiae, Saccharopolyspora erythraea, Salinibacter ruber, Simmodsia chinensis, Solibacter usitatus, Sphingopyxis alaskensis, Stigmatella aurantiaca, Streptomyces avermitilis, Streptomyces coelicolor, Streptomyces griseus, Tenacibaculum* sp. and *Ustilago maydis.* In particular embodiments, the polynucleotide encoding the ester synthase or a variant thereof is overexpressed.

In some embodiments, the method further comprises culturing the host cell in the presence of at least one biological substrate for the ester synthase polypeptide. In certain embodiments, the method comprises culturing the host cell under conditions that are sufficient to allow expression or overexpression of the ester synthase in the host cell. In some embodiments, the method further comprises culturing the host cell under conditions that are sufficient to permit production of fatty acids and/or fatty acid derivatives. In some embodiments, the method comprises culturing the host cell in the presence of a thioester substrate such as, for example, a fatty acyl-CoA or a fatty acyl-ACP. In certain other embodiments, the method comprises culturing the host cell in the presence of an alcohol substrate. In yet further embodiments, the method comprising culturing the host cell in the presence of a free fatty acid.

In another aspect, the invention features a method of producing a fatty acid or a fatty acid derivative such as, for example, a fatty ester. The method comprises expressing in a host cell a heterologous gene encoding an ester synthase having the amino acid sequence of SEQ ID NO:18, or a variant thereof. Alternatively, the method comprises manipulating an endogenous ester synthase gene of a host cell encoding an ester synthase of SEQ ID NO:18, or a variant thereof, using genomic alteration. In some embodiments, the method further includes isolating the fatty acid and/or fatty acid derivative from the host cell.

In yet another aspect, the invention features an in vitro method of producing fatty acids and/or fatty acid derivatives extracellularly from a substrate using a purified ester synthase having the amino acid sequence of SEQ ID NO:18, or a variant thereof. In one embodiment, the host cell is cultured under conditions that allow expression or overexpression of the ester synthase or a variant thereof. The host cell is then be harvested and lysed. Optionally, the resulting mixture is purified. Suitable substrates such as those described herein can be added to the cell-free extracts under conditions that permit production of a fatty acid and/or a fatty acid derivative.

In some embodiments, the ester synthase variant comprises the amino acid sequence of SEQ ID NO:18, with one or more amino acid substitutions, additions, insertions, or deletions, wherein the polypeptide has ester synthase activity and/or acyltransferase activity. In certain embodiments, the ester synthase variant has increased ester synthase and/or acyltransferase activity. For example, the ester synthase polypeptide is capable, or has improved capacity, of catalyzing the conversion of thioesters to fatty esters, using alcohols as substrates. Thioester substrates include, for example, fatty thioesters such as fatty acyl-CoAs or fatty acyl-ACPs. In some embodiments, the ester synthase variant is capable of, or has improved capacity of, catalyzing the conversion of free fatty acids to fatty esters, using alcohols as substrates. Alcohol substrates include, for example, long- or short-chain alcohols such as methanol, ethanol, propanol, butanol, pentanol, hexanol, heptanol, octanol, decanol, dodecanol, tetradecanol, or hexadecanol.

In some embodiments, the ester synthase variant comprises the amino acid sequence of SEQ ID NO:18, with one or more non-conserved amino acid substitutions, wherein the variant retains ester synthase and/or acyltransferase activity. In some embodiments, the ester synthase variant has improved ester synthase and/or acyltransferase activity. In an exemplary embodiment, the glycine residue at position 395 of SEQ ID NO:18 is substituted with a basic amino acid residue, and the resultant ester synthase variant retains or has improved ester synthase and/or acyltransferase activity. In some embodiments, the glycine residue at position 395 of SEQ ID NO:18 is substituted with an arginine or a lysine residue, and the resultant ester synthase variant has improved ester synthase and/or acyltransferase activity.

In some embodiments, the ester synthase variant comprises one or more conserved amino acid substitutions. In some embodiments, the ester synthase variant has about 1, 2, 3, 4, 5, 6, 7, 8, 9, 10, 15, 20, 30, 40, 50, 60, 70, 80, 90, 100, or more amino acid substitutions, additions, insertions, or deletions. In some embodiments, the ester synthase variant has ester synthase and/or acyltransferase activity. For example, the polypeptide is capable of catalyzing the conversion of thioesters to fatty acids and/or fatty acid derivatives such as fatty esters, using alcohols as substrates. In alternative embodiments, the polypeptide is capable of producing a fatty ester from a suitable free fatty acid and an alcohol, such as, for example, long- or short-chain alcohols, such as methanol, ethanol, propanol, butanol, pentanol, hexanol, heptanol, octanol, decanol, dodecanol, tetradecanol, or hexadecanol.

In certain embodiments, an endogenous thioesterase of the host cell, if present, is unmodified. In other embodiments, the method includes modifying the expression of a gene encoding a thioesterase in the host cell. In certain embodiments, modifying the expression of a thioesterase gene includes attenuating the expression of an endogenous gene encoding a thioesterase in the host cell and/or functionally deleting such a gene. In particular embodiments, the thioesterase is encoded by tesA, tesA without leader sequence, tesB, fatB, fatB2, fatB3, fatA, or fatA1.

In some embodiments, the host cell is genetically engineered to express an attenuated level of a fatty acid degradation enzyme relative to its level in a wild type host cell. Exemplary fatty acid degradation enzymes include, without limitation, acyl-CoA synthase enzymes of EC 2.3.1.86 or EC 6.2.1.3. In particular embodiments, the host cell expresses an attenuated level of an acyl-CoA synthase encoded by fadD, fadK, BH3103, yhfL, pfl-4354, EAV15023, fadD1, fadD2, rpc_4074, fadDD35, fadDD22, faa3p or the gene encoding the protein ZP_01644857. In certain embodiments, the aforementioned fatty acid degradation enzyme, such as the acyl-CoA synthase gene, is functionally deleted such that the host cell does not express an acyl-CoA synthase or does not have a detectable acyl-CoA synthase activity.

In certain embodiments, the host cell is genetically engineered to express an attenuated level of a thioesterase, an attenuated level of a fatty acid degradation enzyme, or both. In an exemplary embodiment, a thioesterase, a fatty acid degradation enzyme, or both, are functionally deleted. In some embodiments, the host cell has no detectable level of a thioesterase activity or an acyl-CoA synthase activity. In certain embodiments, the host cell is capable of producing fatty acids and/or derivatives thereof.

In other embodiments, the host cell is genetically engineered to express, relative to a wild type host cell, a decreased level of at least one of a gene encoding an acyl-CoA dehydrogenase, a gene encoding an outer membrane protein receptor, and a gene encoding a transcriptional regulator of fatty acid biosynthesis. In some embodiments, one or more of a gene encoding an acyl-CoA dehydrogenase, a gene encoding an outer membrane protein receptor, and a gene encoding a transcriptional regulator of fatty acid biosynthesis are functionally deleted. In some embodiments, the gene encoding an acyl-CoA dehydrogenase is fadE. In some embodiments, the gene encoding an outer membrane protein receptor is one that encodes a receptor for ferrichrome, colicin M, phage T1, phage T5, or phage phi80. In certain embodiments, the gene encoding an outer membrane protein receptor is fhuA (also known as tonA). In yet other embodiments, the gene encoding a transcriptional regulator of fatty acid biosynthesis is fabR.

In some embodiments, the method further includes culturing the host cell in the presence of at least one biological substrate for the ester synthase polypeptide. In certain embodiments, the method includes culturing the host cell under conditions that allow expression or overexpression of the ester synthase in the host cell. In further embodiments, the method includes culturing the host cell under conditions that permit production of desirable fatty acids and/or fatty acid derivatives. In some embodiments, the method includes culturing the host cell in the presence of a thioester substrate. In certain other embodiments, the method includes culturing the host cell in the presence of an alcohol. In further embodiments, the method includes culturing the host cell in the presence of a free fatty acid.

In another aspect, the invention features a method of producing a fatty acid and/or a fatty acid derivative such as, for example, a fatty ester. The method includes expressing in a host cell a gene encoding an ester synthase polypeptide comprising an amino acid sequence having at least about 35% sequence identity, for example, at least about 40%, 50%, 60%, 70%, 80%, 90%, 91%, 92%, 93%, 94%, 95%, 96%, 97%, 98%, or 99% sequence identity to the amino acid sequence of SEQ ID NO:18. In a further embodiment, the host cell is engineered to have an attenuated level of a thioesterase, a fatty acid degradation enzyme, or both. Alternatively, the thioesterase, the fatty acid degradation enzyme, or both, are functionally deleted. In some embodiments, the host cell has no detectable thioesterase activity or acyl-CoA synthase activity. In some embodiments, the method further includes isolating an accordingly-produced fatty acid or fatty acid derivative from the host cell.

In alternative embodiments, the invention further features an in vitro method of producing a fatty acid and/or fatty acid derivative extracellularly, using a purified ester synthase having at least about 35% sequence identity to the amino acid sequence of SEQ ID NO:18, from a suitable substrate. In an exemplary embodiment, the host cell is cultured under conditions that allow expression or overexpression of the ester synthase enzyme or a variant thereof. The host cell is then harvested and lysed. Optionally, the resulting mixture is purified. Suitable substrates such as those described herein can be added to the cell-free extracts under conditions that permit production of a fatty acid and/or a fatty acid derivative.

In some embodiments, the amino acid sequence of an ester synthase or a suitable variant of the invention has at least about 35%, for example, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% sequence identity to SEQ ID NO:18. In some embodiments, the amino acid sequence of the ester synthase is SEQ ID NO:18. An exemplary ester synthase polypeptide include an ester synthase from *Limnobacter* sp. MED105, with a GenBank Accession No. of ZP_01915978 (SEQ ID NO:41), which has about 51% sequence identity to the amino acid sequence of the ester synthase from *Marinobacter hydrocarbonclasticus* DSM 8798, SEQ ID NO:18.

In certain embodiments, an endogenous thioesterase of the host cell, if present, is unmodified. In other embodiments, the method includes modifying the expression of a gene encoding a thioesterase in the host cell. In certain embodiments, modifying the expression of a thioesterase gene includes attenuating the expression of an endogenous gene encoding a thioesterase in the host cell and/or functionally deleting that gene. In particular embodiments, the thioesterase is encoded by tesA, tesA without leader sequence, tesB, fatB, fatB2, fatB3, fatA, or fatA1.

In some embodiments, the host cell is genetically engineered to express an attenuated level of a fatty acid degradation enzyme relative to its level in a wild type host cell. Exemplary fatty acid degradation enzymes include, without limitation, acyl-CoA synthase enzymes of EC 2.3.1.86 or EC 6.2.1.3. In particular embodiments, the host cell expresses an attenuated level of an acyl-CoA synthase encoded by fadD, fadK, BH3103, yhfL, pfl-4354, EAV15023, fadD1, fadD2, rpc_4074, fadDD35, fadDD22, faa3p or the gene encoding the protein ZP_01644857. In certain embodiments, the aforementioned fatty acid degradation enzyme, such as the acyl-CoA synthase gene, is functionally deleted such that the host cell does not express the acyl-CoA synthase or has no detectable acyl-CoA synthase activity.

In certain embodiments, the host cell is genetically engineered to express an attenuated level of a thioesterase, a fatty acid degradation enzyme such as an acyl-CoA synthase, or both. In an exemplary embodiment, a thioesterase, an acyl-CoA synthase, or both, are functionally deleted. In some embodiments, the host cell is capable of producing fatty acids and/or derivatives thereof.

In other embodiments, the host cell is genetically engineered to express, relative to a wild type host cell, a decreased level of at least one of a gene encoding an acyl-CoA dehydrogenase, a gene encoding an outer membrane protein receptor, and a gene encoding a transcriptional regulator of fatty acid biosynthesis. In some embodiments, one or more of a gene encoding an acyl-CoA dehydrogenase, a gene encoding an outer membrane protein receptor, and a gene encoding a transcriptional regulator of fatty acid biosynthesis are functionally deleted. In some embodiments, the gene encoding an acyl-CoA dehydrogenase is fadE. In some embodiments, the gene encoding an outer membrane protein receptor is one that encodes a receptor for ferrichrome, colicin M, phage T1, phage T5, or phage phi80. In certain embodiments, the gene encoding an outer membrane protein receptor is fhuA (also known as tonA). In yet other embodiments, the gene encoding a transcriptional regulator of fatty acid biosynthesis is fabR.

In another aspect, the invention features a method of producing a fatty acid or a fatty acid derivative such as, for example, a fatty ester. The method includes expressing in a host cell a polynucleotide that hybridizes under low stringency, medium stringency, high stringency, or very high stringency conditions, to a complement of SEQ ID NO:27, or to a fragment thereof, wherein the polynucleotide encodes a polypeptide having ester synthase and/or acyltransferase activity. For example, the polypeptide has ester synthase activity and is capable of converting thioesters to fatty esters, using alcohols as substrates. Suitable thioester substrates include, for example, fatty thioesters such as fatty acyl-CoAs or fatty acyl-ACPs. In other embodiments, the host cell produces fatty esters from free fatty acid and alcohol substrates. Suitable alcohol substrates include, for example, long or short chain alcohols such as methanol, ethanol, propanol, butanol, pentanol, hexanol, heptanol, octanol, decanol, dodecanol, tetradecanol, or hexadecanol.

In certain embodiments, an endogenous thioesterase of the host cell, if present, is unmodified. In other embodiments, the method includes modifying the expression of a gene encoding a thioesterase in the host cell. In some embodiments, modifying the expression of a thioesterase gene includes attenuating the expression of an endogenous gene encoding a thioesterase in the host cell and/or functionally deleting that gene. In particular embodiments, the thioesterase is encoded by tesA, tesA without leader sequence, tesB, fatB, fatB2, fatB3, fatA, or fatA1.

In some embodiments, the host cell is genetically engineered to express an attenuated level of a fatty acid degradation enzyme relative to its level in a wild type host cell. Exemplary fatty acid degradation enzymes include, without limitation, acyl-CoA synthase enzymes of EC 2.3.1.86 or EC 6.2.1.3. In particular embodiments, the host cell expresses an attenuated level of an acyl-CoA synthase encoded by fadD, fadK, BH3103, yhfL, pfl-4354, EAV15023, fadD1, fadD2, rpc_4074, fadDD35, fadDD22, faa3p or the gene encoding the protein ZP_01644857. In certain embodiments, the aforementioned fatty acid degradation enzyme, such as the acyl-CoA synthase gene, is functionally deleted such that the host cell does not express an acyl-CoA synthase or has no detectable acyl-CoA synthase activity.

In certain embodiments, the host cell is genetically engineered to express an attenuated level of a thioesterase, a fatty acid degradation enzyme such as an acyl-CoA synthase, or both. In some embodiment, a thioesterase, an acyl-CoA synthase, or both, are functionally deleted. In some embodiments, the host cell is capable of producing fatty acids and/or derivatives thereof.

In other embodiments, the host cell is genetically engineered to express, relative to a wild type host cell, a decreased level of at least one of a gene encoding an acyl-CoA dehydrogenase, a gene encoding an outer membrane protein receptor, and a gene encoding a transcriptional regulator of fatty acid biosynthesis. In some embodiments, one or more of a gene encoding an acyl-CoA dehydrogenase, a gene encoding an outer membrane protein receptor, and a gene encoding a transcriptional regulator of fatty acid biosynthesis are functionally deleted. In some embodiments, the gene encoding an acyl-CoA dehydrogenase is fadE. In some embodiments, the gene encoding an outer membrane protein receptor is one that encodes a receptor for ferrichrome, colicin M, phage T1, phage T5, or phage phi80. In certain embodiments, the gene encoding an outer membrane protein receptor is fhuA (also known as tonA). In yet other embodiments, the gene encoding a transcriptional regulator of fatty acid biosynthesis is fabR.

In some embodiments, the method further includes culturing the host cell in the presence of at least one biological substrate of the ester synthase. In certain embodiments, the method includes culturing the host cell under conditions that allow expression or overexpression of the ester synthase enzyme in the host cell. In further embodiments, the method includes culturing the host cell under conditions that permit production of fatty acids and/or fatty acid derivatives. In some embodiments, the method includes culturing the host cell in the presence of a thioester substrate. In some other embodiments, the method includes culturing the host cell in the presence of an alcohol substrate. In other embodiments, the method includes culturing the host cell in the presence of a free fatty acid.

In some embodiments, the method further includes isolating an accordingly-produced fatty acid or fatty acid derivative from the host cell. In some embodiments, the fatty acid or fatty acid derivative is present in the extracellular environment. In certain embodiments, the fatty acid or fatty acid derivative is isolated from the extracellular environment of the host cell. In some embodiments, the fatty acid or fatty acid derivative is spontaneously secreted, partially or completely, from the host cell. In alternative embodiments, the fatty acid or fatty acid derivative is transported into the extracellular environment, with or without the aid of one or more suitable transport proteins. In other embodiments, the fatty acid or fatty acid derivative is passively transported into the extracellular environment.

In an alternative embodiment, the invention features an in vitro method of producing a fatty acid and/or fatty acid derivative extracellularly, using a purified ester synthase encoded by a polynucleotide that hybridizes to a complement of SEQ ID NO:27, or to a fragment thereof, and a suitable substrate. For example, the host cell can be cultured under conditions that allow expression or overexpression of the ester synthase enzyme or a variant thereof, and the cell is then be harvested and lysed. Optionally, the resulting mixture can be purified. Suitable substrates such as those described herein can be added to the cell-free extracts under conditions that permit production of a fatty acid and/or a fatty acid derivative.

In another aspect, the invention features a method of producing a fatty acid and/or a fatty acid derivative such as, for example, a fatty ester. The method includes expressing in a host cell a recombinant vector comprising an ester synthase polynucleotide sequence having at least about 50% sequence identity to a polynucleotide sequence in FIG. 16. In some embodiments, the nucleotide sequence has at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to the nucleotide sequence of SEQ ID NO:27, 28, 29, or 30. In some embodiments, the nucleotide sequence is SEQ ID NO:27, 28, 29, or 30. In an exemplary embodiment, a recombinant vector comprising an ester synthase polynucleotide sequence of SEQ ID NO:42 (codon-optimized from a polynucleotide encoding an ester synthase homolog from *Limnobacter* sp. MED105), which has about 50% sequence identity to SEQ ID NO:27, can be expressed in a host cell to produce a fatty acid and/or derivative thereof. In certain embodiments, the host cell is engineered to express an attenuated level of a thioesterase, a fatty acid degradation enzyme, or both. In some embodiments, a thioesterase, a fatty acid degradation enzyme, or both, are functionally deleted. In certain embodiments, the host cell iscapable of producing fatty acids and/or derivatives thereof.

In some embodiments, the method further includes isolating the fatty acid or fatty acid derivative from the host cell. In some embodiments, the fatty acid or fatty acid derivative is present in the extracellular environment. In certain embodiments, the fatty acid or fatty acid derivative is isolated from the extracellular environment of the host cell. In some embodiments, the fatty acid or fatty acid derivative is spontaneously secreted, partially or completely, from the host cell. In alternative embodiments, the fatty acid or fatty acid derivative is transported into the extracellular environment, with or without the aid of one or more suitable transport proteins. In other embodiments, the fatty acid or fatty acid derivative is passively transported into the extracellular environment.

In another aspect, the invention further features an in vitro method of producing a fatty acid and/or fatty acid derivative extracellularly, wherein a host cell comprising a recombinant vector comprising an ester synthase nucleotide sequence having at least about 50% sequence identity to a nucleotide sequence listed in FIG. 16 is cultured under conditions that allow expression or overexpression of an ester synthase. The host cell is then harvested and lysed. Optionally, the resulting mixture is purified. A suitable substrate is then added to the cell free extract under conditions that permit production of a fatty acid and/or a fatty acid derivative in vitro.

In some embodiments, the recombinant vector further comprises a promoter operably linked to a nucleotide sequence encoding an ester synthase or a suitable variant. In certain embodiments, the promoter is a developmentally-regulated, or organelle-specific, a tissue-specific, an inducible, a constitutive, or a cell-specific promoter.

In other embodiments, the recombinant vector comprises at least one sequence selected from the group consisting of (a) a regulatory sequence operatively coupled to the nucleotide sequence; (b) a selection marker operatively coupled to the nucleotide sequence; (c) a marker sequence operatively coupled to the nucleotide sequence; (d) a purification moiety operatively coupled to the nucleotide sequence; (e) a secretion sequence operatively coupled to the nucleotide sequence; and (f) a targeting sequence operatively coupled to the nucleotide sequence.

In some embodiments, the recombinant vector is a plasmid.

In some embodiments, the host cell expresses an ester synthase polypeptide that is encoded by the recombinant vector. In some embodiments, the nucleotide sequence is stably incorporated into the genomic DNA of the host cell, and the expression of the nucleotide sequence is under the control of a regulated promoter region.

In certain embodiments, an endogenous thioesterase of the host cell, if present, is unmodified. In other embodiments, the method includes modifying the expression of a gene encoding a thioesterase in the host cell. In some embodiments, modifying the expression of a thioesterase gene includes attenuating the expression of an endogenous gene encoding a thioesterase in the host cell and/or functionally deleting that gene. In particular embodiments, the thioesterase is encoded by tesA, tesA without leader sequence, tesB, fatB, fatB2, fatB3, fatA, or fatA1.

In some embodiments, the host cell is genetically engineered to express an attenuated level of a fatty acid degradation enzyme relative to its level in a wild type host cell. Exemplary fatty acid degradation enzymes include, without limitation, acyl-CoA synthase enzymes of EC 2.3.1.86, or EC 6.2.1.3. In particular embodiments, the host cell expresses an attenuated level of an acyl-CoA synthase encoded by fadD, fadK, BH3103, yhfL, pfl-4354, EAV15023, fadD1, fadD2, rpc_4074, fadDD35, fadDD22, faa3p or the gene encoding the protein ZP_01644857. In certain embodiments, the aforementioned fatty acid degradation enzyme, such as the acyl-CoA synthase gene, is functionally deleted such that the host cell does not express an acyl-CoA synthase, or has no acyl-CoA synthase activity.

In other embodiments, the host cell is genetically engineered to express, relative to a wild type host cell, a decreased level of at least one of a gene encoding an acyl-CoA dehydrogenase, a gene encoding an outer membrane protein receptor, and a gene encoding a transcriptional regulator of fatty acid biosynthesis. In some embodiments, one or more of a gene encoding an acyl-CoA dehydrogenase, a gene encoding an outer membrane protein receptor, and a gene encoding a transcriptional regulator of fatty acid biosynthesis are functionally deleted. In some embodiments, the gene encoding an acyl-CoA dehydrogenase is fadE. In some embodiments, the gene encoding an outer membrane protein receptor is one that encodes a receptor for ferrichrome, colicin M, phage T1, phage T5, or phage phi80. In certain embodiments, the gene encoding an outer membrane protein receptor is fhuA (also known as tonA). In yet other embodiments, the gene encoding a transcriptional regulator of fatty acid biosynthesis is fabR.

In some embodiments, the method further includes culturing the host cell in the presence of at least one biological substrate of the ester synthase. In some embodiments, the method includes culturing the host cell under conditions that allow expression or overexpression of the ester synthase in the host cell. In further embodiments, the method includes culturing the host cell under conditions that permit production of fatty acids and/or fatty acid derivatives. In some embodiments, the method includes culturing the host cell in the presence of a thioester substrate. In other embodiments, the method includes culturing the host cell in the presence of an alcohol substrate. In further embodiments, the method includes culturing the host cell in the presence of a free fatty acid.

In another aspect, the invention features a method of producing a fatty acid and/or a derivative thereof such as, for example, a fatty ester. The method includes expressing in a host cell a recombinant vector comprising an ester synthase nucleotide sequence having at least about 50% sequence identity to the nucleotide sequence of SEQ ID NO:27. In certain embodiments, the host cell is engineered to express an attenuated level of a thioesterase, a fatty acid degradation enzyme such as an acyl-CoA synthase, or both. In an exemplary embodiment, an endogenous thioesterase, an acyl-CoA synthase, or both are functionally deleted. In some embodiments, the host cell is capable of producing fatty acids and/or derivatives thereof.

In some embodiments, the method further includes isolating the fatty acid and/or fatty acid derivative from the host cell. In some embodiments, the fatty acid or fatty acid derivative is present in the extracellular environment. In certain embodiments, the fatty acid or fatty acid derivative is isolated from the extracellular environment of the host cell. In some embodiments, the fatty acid or fatty acid derivative is spontaneously secreted, partially or completely, from the host cell. In alternative embodiments, the fatty acid or fatty acid derivative is transported into the extracellular environment, with or without the aid of one or more suitable transport proteins. In other embodiments, the fatty acid or fatty acid derivative is passively transported into the extracellular environment.

In yet another aspect, the invention features an in vitro method of producing a fatty acid and/or fatty acid derivative extracellularly, wherein a host cell comprises a recombinant vector, which in turn comprises an ester synthase polynucleotide sequence having at least about 50% identity to SEQ ID NO:27, and wherein the host cell is cultured under conditions that allow expression or overexpression of the ester synthase. The host cell is then harvested and lysed. Optionally, the resulting mixture is purified. A suitable substrate, for example, one selected from those described herein, is then added to the cell free extract under conditions that permit production of a fatty acid and/or a fatty acid derivative in vitro.

In some embodiments, the nucleotide sequence has at least about 55%, at least about 60%, at least about at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to the nucleotide sequence of SEQ ID NO:27. In some embodiments, the nucleotide sequence is SEQ ID NO:27.

In certain embodiments, an endogenous thioesterase of the host cell, if present, is unmodified. In certain other embodiments, the method further includes modifying the expression of a gene encoding a thioesterase in the host cell. In certain embodiments, modifying the expression of a thioesterase gene includes attenuating the expression of an endogenous gene encoding a thioesterase in the host cell and/or functionally deleting that gene. In particular embodiments, the thioesterase is encoded by tesA, tesA without leader sequence, tesB, fatB, fatB2, fatB3, fatA, or fatA 1.

In some embodiments, the host cell is genetically engineered to express an attenuated level of a fatty acid degradation enzyme relative to its level in a wild type host cell. Exemplary fatty acid degradation enzymes include, without limitation, acyl-CoA synthase enzymes of EC 2.3.1.86 or EC 6.2.1.3. In particular embodiments, the host cell expresses an attenuated level of an acyl-CoA synthase encoded by fadD, fadK, BH3103, yhfL, pfl-4354, EAV15023, fadD1, fadD2, rpc_4074, fadDD35, fadDD22, faa3p or the gene encoding the protein ZP_01644857. In certain embodiments, the aforementioned fatty acid degradation enzyme, such as the acyl-CoA synthase gene, is functionally deleted such that the host cell does not express an acyl-CoA synthase or has no acyl-CoA synthase activity.

In certain embodiments, the host cell is genetically engineered to express attenuated level of a thioesterase, an attnenuated level of a fatty acid degradation enzyme such as an acyl-CoA synthase, or both. In some embodiments, a thioesterase, an acyl-CoA synthase, or both, are functionally deleted. In certain embodiments, the host cell is capable of producing fatty acids and/or derivatives thereof.

In other embodiments, the host cell is genetically engineered to express, relative to a wild type host cell, a decreased level of at least one of a gene encoding an acyl-CoA dehydrogenase, a gene encoding an outer membrane protein receptor, and a gene encoding a transcriptional regulator of fatty acid biosynthesis. In some embodiments, one or more of a gene encoding an acyl-CoA dehydrogenase, a gene encoding an outer membrane protein receptor, and a gene encoding a transcriptional regulator of fatty acid biosynthesis are functionally deleted. In some embodiments, the gene encoding an acyl-CoA dehydrogenase is fadE. In some embodiments, the gene encoding an outer membrane protein receptor is one that encodes a receptor for ferrichrome, colicin M, phage T1, phage T5, or phage phi80. In certain embodiments, the gene encoding an outer membrane protein receptor is fhuA (also known as tonA). In yet other embodiments, the gene encoding a transcriptional regulator of fatty acid biosynthesis is fabR.

In some embodiments, the recombinant vector further comprises a promoter operably linked to the nucleotide sequence encoding an ester synthase or a variant thereof. In certain embodiments, the promoter is a developmentally-regulated, or organelle-specific, a tissue-specific, an inducible, a constitutive, or a cell-specific promoter.

In other embodiments, the recombinant vector comprises at least one sequence selected from the group consisting of (a) a regulatory sequence operatively coupled to the nucleotide sequence; (b) a selection marker operatively coupled to the nucleotide sequence; (c) a marker sequence operatively coupled to the nucleotide sequence; (d) a purification moiety operatively coupled to the nucleotide sequence; (e) a secretion sequence operatively coupled to the nucleotide sequence; and (f) a targeting sequence operatively coupled to the nucleotide sequence.

In some embodiments, the recombinant vector is a plasmid.

In some embodiments, the host cell expresses an ester synthase or a suitable variant that is encoded by the recombinant vector. In some embodiments, the nucleotide sequence is stably incorporated into the genomic DNA of the host cell, and the expression of the nucleotide sequence is under the control of a regulated promoter region.

In some embodiments, the method further includes culturing the host cell in the presence of at least one biological substrate of the ester synthase. In certain embodiment, the method includes culturing the host cell under conditions that are sufficient to allow expression or overexpression of the ester synthase in the host cell. In further embodiments, the method includes culturing the host cell under conditions that are sufficient to permit production of fatty acids and/or fatty acid derivatives.

In certain embodiments, an endogenous thioesterase of the host cell, if present, is unmodified. In other embodiments, the host cell expresses an attenuated level of a thioesterase. In an exemplary embodiment, a thioesterase is functionally deleted. In further embodiments, the host cell expresses an attenuated level of a fatty acid degradation enzyme, such as an acyl-CoA synthase. In other embodiments, an endogenous fatty acid degradation enzyme, such as an acyl-CoA synthase, is functionally deleted. In some embodiments, the host cell is cultured in the presence of a thioester. In other embodiments, the host cell is cultured in the presence of a suitable alcohol substrate. In yet further embodiments, the host cell is cultured in the presence of a free fatty acid.

In any of the aspects of the invention described herein, the host cell can be selected from the group consisting of a mammalian cell, a plant cell, an insect cell, a yeast cell, a fungus cell, a filamentous fungi cell, a cyanobacterial cell, and a bacterial cell.

In some embodiments, the host cell is a Gram-positive bacteria cell. In other embodiments, the host cell is a Gram-negative bacteria cell.

In some embodiments, the host cell is selected from the genus *Escherichia, Bacillus, Lactobacillus, Rhodococcus, Pseudomonas, Aspergillus, Trichoderma, Neurospora, Fusarium, Humicola, Rhizomucor, Kluyveromyces, Pichia, Mucor, Myceliophtora, Penicillium, Phanerochaete, Pleurotus, Trametes, Chrysosporium, Saccharomyces, Stenotrophamonas, Schizosaccharomyces, Yarrowia,* or *Streptomyces.*

In certain embodiments, the host cell is a *Bacillus lentus* cell, a *Bacillus brevis* cell, a *Bacillus stearothermophilus* cell, a *Bacillus licheniformis* cell, a *Bacillus alkalophilus* cell, a *Bacillus coagulans* cell, a *Bacillus circulans* cell, a *Bacillus pumilis* cell, a *Bacillus thuringiensis* cell, a *Bacillus clausii* cell, a *Bacillus megaterium* cell, a *Bacillus subtilis* cell, or a *Bacillus amyloliquefaciens* cell.

In other embodiments, the host cell is a *Trichoderma koningii* cell, a *Trichoderma viride* cell, a *Trichoderma reesei* cell, a *Trichoderma longibrachiatum* cell, an *Aspergillus awamori* cell, an *Aspergillus fumigates* cell, an *Aspergillus foetidus* cell, an *Aspergillus nidulans* cell, an *Aspergillus niger* cell, an *Aspergillus oryzae* cell, a *Humicola insolens* cell, a *Humicola lanuginose* cell, a *Rhodococcus opacus* cell, a *Rhizomucor miehei* cell, or a *Mucor michei* cell.

In yet other embodiments, the host cell is a *Streptomyces lividans* cell or a *Streptomyces murinus* cell.

In yet other embodiments, the host cell is an *Actinomycetes,* a *Saccharomyces cerevisiae* cell, a *Candida Lipolytica* (or *Yarrowia lipolytica*) cell, an *E. coli Arthrobacter* AK19 cell, a *Rhodotorula glutinins* cell, an *Acintobacter* sp. Strain M-1 cell, or a cell from other oleaginous microorganism.

In some embodiments, the host cell is a cell of an oleaginous yeast, for example, a *Yarrowia,* a *Candida,* a *Rhodotorula,* a *Rhodosporidium,* a *Cryptococcus,* a *Trichosporon,* or a *Lipomyces.* In certain embodiments, the host cell is a cell of *Rhodosporidium toruloide, Lipomyces starkeyii, L. Lipoferus, Candida revkaufi, C. pulcherrima, C. Tropicalis, C. utilis, Trichosporon pullas, T cutaneum, Rhodotorula glutinous, R. Garminis,* and *Yarrowia lipolytica* (formally classified as *Candida lipolytica*). In particular embodiments, the host cell is a cell from *Yarrowia lipolytica* strain ATCC #20362, ATCC #8862, ATCC #18944, ATCC #76982 and/or LGAM S(7)1 (Papanikolaou S., and Aggelis G., Bioresour. Technol., 82(1):43-9, 2002).

As used herein, the term "oleaginous" refers to those organisms that tend to store their energy source in the form of lipid (or oil) (Weete, Fungal Lipid Biochemistry, $2^{nd}$ Ed., Plenum, 1980). And for the purpose herein, oleaginous organisms can be bacteria, algae, moss, yeast, fungi, or plants that have the ability to produce oils.

The term "oleaginous yeast" refers to those microorganisms classified as yeasts that can make oil. Generally, the cellular oil or triacylglycerol content of oleaginous microorganisms follows a sigmoid curve, wherein the concentration of lipid increases until it reaches a maximum at the late logarithmic or early stationary growth phase and then gradually decreases during the late stationary and death phases (Yongmaitchai & Ward, Appi. Environ. Microbiol. 57:419-25 (1991)). It is not uncommon for oleaginous microorganism to accumulate in excess of about 25% of their dry cell weight as oil. Examples of oleaginous yeast include, but are not limited to, the following genera: *Yarrowia, Candida, Rhodotorula, Rhodosporidium, Cryptococcus, Trichosporon,* and *Lipomyces.*

In particular embodiments, the host cell is a cell from an eukaryotic plant, algae, cyanobacterium, green-sulfur bacterium (including, e.g., *Chlorobium, Clathrochloris, Prosthecochloris*), green non-sulfur bacterium (including, e.g., *Chloroflexus, chloronema, Oscillochloris, Heliothrix, Herpetosiphon, Roseiflexus,* and *Termomicrobium*), purple sulfur bacterium (including, e.g., *Allochromatium, Chromatium, Halochromatium, Isochromatium, Marichromatium, Rhodovulum, Thermochromatium, Thiocapsa, Thiorhodococcus,* and *Thiocystis*), purple non-sulfur bacterium (including, e.g., *Phaeospirillum, Rhodobac, Rhodobacter, Rhodomicrobium, Rhodopila, Rhodopseudomonas, Rhodothalassium, Rhodovibrio, Roseospira*), extremophile, yeast, fungus, engineered organisms thereof, or a synthetic organism.

In some embodiments, the host cell is light dependent or fixes carbon via one of the known pathways including, for example, the Calvin cycle pathway, the acetyl CoA pathway, and the reductive TCA pathway. See, e.g., Fuchs, G, Alternative pathways of autotrophic CO2 fixation, p. 365-382 (1989), AUTOTROPHIC BACTERIA, Springer-Verlag, Berlin, Germany (H. G. Schlegel & B. Bowien ed.). In some embodiments, the host cell has autotrophic activity. In some embodiments, the host cell has photoautotrophic activity, such as in the presence of light. In some embodiments, the host cell is heterotrophic or mixotrophic in the absence of light. In certain embodiments, the host cell is a cell from an extremphile, which are known to withstand various extreme environmental parameters such as temperature, radiation, pressure, gravity, vacuum, desiccation, salinity, pH, oxygen tension and chemicals. Host cells from various known extremephiles can be suitable. For example, the host cell can be from a hyperthermophile such as *Pyrolobus fumarii*, which grow at or above 80° C. In another example, the host cell can be from a thermophiles such as a *Synechococcus lividis*, which grow between 60-80° C. In a further example, the host cell can be from a mesophiles, which grow between 15-60° C. In yet a further example, the host cell can be from a psychrophile such as a psychrobacter or certain insect, which grow at or below 15° C. Moreover, the host cell can be from a radiation tolerant organism such as a *Deinocaccus radiodurans*. In some embodiments, the host cell can be from a pressure tolerant organism, such as a piezophile which tolerate pressure of 130 MPa. Alternately, the host cell can be from weight tolerant organisms such as a barophile. In some other embodiments, the host cell can be a hypergravity (e.g., >1 g) or a hypogravity (e.g., <1 g) tolerant organism. In further embodiments, the host cell can be from a vacuum tolerant organism such as a tardigrade, insect, microbe and seed. In yet further embodiments, the host cell can be from a dessicant tolerant and anhydrobiotic organism such as a xerophile *Artemia salina*, a nematode, a certain microbe, a certain fungus and a lichen. In certain other embodiments, the host cell is from a salt tolerant organism such as a halophiles (e.g., 2-5 M NaCl) *Halobacteriacea* and *Dunalielia salina*. The host cell can also be from a pH tolerant organism such as an alkaliphiles *Natronobacterium*, *Bacillus firmus* OF4, *Spirulina* spp. (e.g., pH>9) or an acidophiles such as a *Cyanidium caldarium*, *Ferroplasma* sp. (e.g., low pH). The host cell can alternatively be from an anaerobes, which cannot tolerate $O_2$, such as a *Methanococcus jannaschii*, or a microaerophil, which tolerates some $O_2$, such as a *Clostridium*, and an aerobe, which requires $O_2$. Furthermore, the host cell can be from a gas tolerant organism, which tolerates pure $CO_2$, including, for example, a *Cyanidium caldarium*. The host cell can be from a metal tolerant organism, including, for example a metalotolerant such fps *Ferroplasma acidarmanus* (e.g., Cu, As, Cd, Zn), *Ralstonia* sp. CH34 (e.g., Zn, Co, Cd, Hg, Pb). See, e.g., Gross, Michael. Life on the Edge: Amazing Creatures Thriving in Extreme Environments. New York: Plenum (1998); Seckbach, J. "Search for Life in the Universe with Terrestrial Microbes Which Thrive Under Extreme Conditions." In Cristiano Batalli Cosmovici, Stuart Bowyer, and Dan Wertheimer, eds., Astronomical and Biochemical Origins and the Search or Life in the Universe, p. 511. Milan: Editrice, Compositori (1997).

In certain embodiments, the host cell can be from plants, including, without limitation, plants of the genera: *Arabidopsis, Beta, Glycine, Jatropha, Miscanthus, Panicum, Phalaris, Populus, Saccharum, Salix, Simmondsia*, and *Zea*. For example, the host cell can be from *Arabidopsis thaliana, Panicum virgatum, Miscanthus giganteus*, or *Zea mays*. In other embodiments, the host cell can be from algae and cyanobacteria, including, without limitation, the genera: *Acanthoceras, Acanthococcus, Acaryochloris, Achnanthes, Achnanthidium, Actinastrum, Actinochloris, Actinocyclus, Actinotaenium, Amphichrysis, Amphidinium, Amphikrikos, Amphipleura, Amphiprora, Amphithrix, Amphora, Anabaena, Anabaenopsis, Aneumastus, Ankistrodesmus, Ankyra, Anomoeoneis, Apatococcus, Aphanizomenon, Aphanocapsa, Aphanochaete, Aphanothece, Apiocystis, Apistonema, Arthrodesmus, Artherospira, Ascochloris, Asterionella, Asterococcus, Audouinella, Aulacoseira, Bacillaaria, Balbiania, Bambusina, Bangia, Basichlamys, Batrachospermum, Binuclearia, Bitrichia, Blidingia, Botradiopsis, Botrydium, Botryococcus, Botryosphaerella, Brachiomonas, Brachysira, Brachytrichia, Brebissonia, Bulbochaete, Bumilleria, Bumilleriopsis, Caloneis, Calothrix, Campy lodiscus, Capsosiphon, Carteria, Catena, Cavinula, Centritractus, Centronella, Ceratium, Chaetoceros, Chaetochloris, Chaetomorpha, Chaetonella, Chaetonema, Chaetapeltis, Chaetophora, Chaetosphaeridium, Chamaesiphon, Chara, Characiochloris, Characiopsis, Characium, Charales, Chilomonas, Chlaniomonas, Chlamydoblepharis, Chlamydocapsa, Chamydomonas, Chlamydomonopsis, Chlamydomyxa, Chlamydonephris, Cholrangiella, Chloranglopsis, Chlorella, Chlorobotrys, Chlorobrachis, Chlorochytrium, Chlorococcum, Chlorogloea, Chlorogloeopsis, Chlorogonium, Chlorolobion, Chloromonas, Chlorophysema, Chlorophyta, Chlorosaccus, Chlorosarcina, Choricystis, Chromophyton, Chromulina, Chroococcidiopsis, Chroococcus, Chroodactylon, Chroomonas, Chroothece, Chrysamoeba, Chrysapsis, Chrysidiastrum, Chrysocapsa, Chrysocapsella, Chrysochaete, Chrysochromulina, Chrysococcus, Chrysocrinus, Chrysolepidomonas, Chrysolykos, Chrysonebula, Chrysophyta, Chrysopyxis, Chrysosaccus, Chrysophaerella, Chrysostephanosphaera, Clodophora, Clastidium, Closteriopsis, Closterium, Coccomyxa, Cocconeis, Coelastrella, Coelastrum, Coelosphaerium, Coenochloris, Coenococcus, Coenocystis, Colacium, Coleochaete, Collodictyon, Compsogonopsis, Compsopogon, Conjugatophyta, Conochaete, Coronastrum, Cosmarium, Cosmioneis, Cosmocladium, Crateriportula, Craticula, Crinalium, Crucigenia, Crucigeniella, Cryptoaulax, Cryptomonas, Cryptophyta, Ctenophora, Cyanodictyon, Cydnonephron, Cyanophora, Cyanophyta, Cyanothece, Cyanothomonas, Cyclonexis, Cyclostephanos, Cyclotello, Cylindrocapsa, Cylindrocystis, Cylindrospermum, Cylindrotheca, Cymatopleura, Cymbella, Cymbellonitzschia, Cystodinium Dactylococcopsis, Debarya, Denticula, Dermatochrysis, Dermocarpa, Dermocarpella, Desmatractum, Desmidium, Desmococcus, Desmonema, Desmosiphon, Diacanthos, Diacronema, Diadesmis, Diatoma, Diatomella, Dicellula, Dichothrix, Dichotomococcus, Dicranochaete, Dictyochloris, Dictyococcus, Dictyosphaerium, Didymocystis, Didymogenes, Didymosphenia, Dilabifilum, Dimorphococcus, Dinobryon, Dinococcus, Diplochloris, Diploneis, Diplostauron, Distrionella, Docidium, Draparnaldia, Dunaliella, Dysmorphoccus, Ecballocystis, Elakatothrix, Ellerbeckia, Encyoneme, Enteromorpha, Entocladia, Entomoneis, Entophysalis, Epichrysis, Epipyxis, Epithemia, Eremosphaera, Euastropsis, Euastrum, Eucapsis, Eucocconeis, Eudorina, Euglena, Euglenophyta; Eunotia, Eustigmatophyta, Eutreptia, Fallacia, Fischerella, Fragilaria, Fragilariforma, Franceia, Frustulia, Geminella, Genicularia, Glaucocystis, Glaucophyta, Glenodiniopsis, Glenodinium, Gloeocapsa, Gloeochaete, Gloeochrysis, Gloeococcus, Gloeocystis, Gloeodendron, Gloeomonas, Gloeoptax, Gloeothece, Gloeotita, Gloeotrichia, Gloiodictyon, Golenkinia, Golenkiniopsis, Gomontia, Gomphocymbella, Gomphonema, Gomphosphaeria, Gonatozygon, Gongrosia, Gongrosira, Goniochloris, Gonium, Gonyostomum, Granulochloris, Granulocystopsis, Groenbladia, Gymnodinium, Gymnozyga, Gyrosigma, Haematococcus, Hafniomonas, Hallassia, Hammatoidea, Hannaea, Hantzschia, Hapalosiphon, Haplotaenium. Haptophyta, Hasiea, Hemidinium, Hemitonia, Heribaudiella, Heteromastix. Heterothrix, Hibberdia, Hildenbrandia, Hillea, Holopedium, Homoeothrix, Hormanthonema, Hormotila, Hyalobrachion, Hyalocardium, Hyalodiscus, Hyalogonium, Hyalotheca, Hydrianum, Hydrococcus, Hrydrocoleum, Hydrocoryne, Hydrodictyon, Hydrosera,*

*Hydrurus, Hyella, hymenomonas, Isthmochloron, Johannesbaptistia, Juranyiella, Karayevia, Kathablepharis, Katodinium, Kephyrion, Keratococcus, Kirchneriella, Klebsormidium, Kolbesia, Koliella, Komarekia, Korshikoviella, Kraskella, Lagerheimia, Lagynion, Lamprothamnium, Lemanea, Lepocinclis; Leptosira, Lobococcus, Lobocystis, Lobomonas, Luticola, Lyngbya, Malleochloris, Mallononas, Mantoniella, Marssoniella, Martyana, Mastigocoleus, Gastogloia, Melosira, Merismopedia, Mesostigma, Mesotuenium, Micr actinium, Micrasterias, Microchaete, Microcoleus, Microcystis, Microglena, Micromonas, Microspora; Microthammion, Mischococcus, Monochrysis, Monodus, Monomastix, Monoraphidium, Monostroma, Mougeotia, Mougeotiopsis, Myochloris, Myromecia, Myxosarcina, Naegeliella, Nannochloris, Nautococcus, Navicula, Neglectella, Neidium, Nephroclamys, Nephrocytium, Nephrodiella, Nephroselmis, Netrium, Nitella, Nitellopsis, Nitzschia, Nodulaaria, Nostoc, Ochromonas, Oedogonium, Oligochaetophora, Onychonema, Oocardium, Oocystis, Opephora, Ophocytium, Orthoseira, Oscillatoria, Oxynesis, Pachycladella, Palmella, Palmodictyon, Pnadorina, Pannus, Paralia, Pascherina, Paulschulzia, Pediastrum, Pedinella, Pedinomonas, Pedinopera, Pelagodictyon, Penium, Peranema, Peridiniopsis, Peridinium, Peronia, Petroneis, Phacotus, Phacus, Phaeaster, Phaeodermatium, Phaeophyta, Phaeosphaera, Phaeothamnion, Phormidium, Phycopeltis, Phyllariochloris, Phyllocardium, Phyllomitas, Pinnularia, Pitophora, Placoneis, Planctonema, Planktosphaeria, Planothidium, Plectonema, Pleodorina, Pleurastrum, Pleurocapsa, Pleurocladia, Pleurodiscus, Pleurosigma, Pleurosira, Pleurotaenium, Pocillomonas, Podohedra, Polyblepharides, Polychaetophora, Polyedriella, Polyedriopsis, Polygoniochloris, Polyepidomonas, Polytaenia, Polyedriella, Polyedriopsis, Polygoniochloris, Polyepidomonas, Prasinochloris, Prasinocladus, Prasinophyta, Prasiola, Prochlorphyta, Prochlorothrix, Protoderma, Protosiphon, Provasoliella, Prymnesium, Psammodictyon, Psammothidium, Pseudanabaena, Pseudenoclonium, Psuedocarteria, Pseudochate, Pseudocharacium, Pseudococcomyxa, Pseudodictyosphaerium, Pseudokephyrion, Pseudoncobyrsa, Pseudoquadrigula, Pseudosphaerocystis, Pseudostaurastrum, Pseudostaurosira, Pseudotetrastrum, Pieromonas, Punctastruata, Pyramichlamys, Pyramimonas, Pyrrophyta, Quadrichloris, Quadricoccus, Quadrigula, Radiococcus, RadioBlum, Raphidiopsis, Raphidocelis, Raphidonema, Raphidophyta, Peimeria, Rhabdoderma, Rhabdomonas, Rhizoclonium, Rhodomonas, Rhodophyta, Rhoicosphenia, Rhopalodia, Rivularia, Rosenvingiella, Rossithidium, Roya, Scenedesmus, Scherffelia, Schizochlamydella, Schizochlamys, Schizomeris, Schizothrix, Schroederia, Scolioneis, Scotiella, Scotiellopsis, Scourfieldia, Scytonema, Selenastrum, Selenochloris, Sellaphora, Semiorbis, Siderocelis, Diderocystopsis, Dimonsenia, Siphononema, Sirocladium, Sirogonium, Skeletonema, Sorastrum, Spermatozopsis, Sphaerellocystis, Sphaerellopsis, Sphaerodinium, Sphaeroplea, Sphaerozosma, Spiniferomonas, Spirogyra, Spirotaenia, Spirulina, Spondylomorum, Spondylosium, Sporotetras, Spumella, Staurastrum, Stauerodesmus, Stauronesis, Staurosira, Staurosirella, Stenopterobia, Stephanocostis, Stephanodiscus, Stephanoporos, Stephanosphaera, Stichococcus, Stichogioea, Stigeoclonium, Stigonema, Stipitococcus, Stokesiella, Strombomonas, Stylochrysalis, Stylodinium, Styloyxis, Stylosphaeridium, Surirella, Sykidion, Symploca, Synechococcus, Synechocystis, Synedra, Synochromonas, Synura, Tabellaria, Tabularia, Teilingia, Temnogametum, Tetmemorus, Tetrachlorella, Tetracyclus, Tetradesmus, Tetraedriella, Tetraedron, Tetraselmis, Tetraspora Tetrastrum, Thalassiosira, Thamniochaete, Thorakochloris, Thorea, Tolypella, Tolypothrix, Trachelomonas, Trachydiscus, Trebouxia, Trentepholia, Treubaria, Tribonema, Trichodesmium, Triodiscus, Trochiscia, Tryblionella, Ulothrix, Uroglena, Uronema, Urosolenia, Urospora, Uva, Vacuolaria, Vaucheria, Volvox, Volvulina: Westella, Woloszynskia, Xanthidium, Xanthophyta, Xenococcus, Zygnema, Zygnemopsis*, and *Zygonium*.

Exemplary microorganisms from which the host cell can be derived include, without limitation, *Arabidopsis thaliana, Botryococcus braunii, Chlamydomonas reinhardtii, Dunaliela sauna, Synechococcus* Sp. PCC 7002, *Synechococcus* Sp. PCC 7942, *Synechocystis* Sp. PCC 6803, *Thermosynechococcus elongatus* BP-1, *Chlorobium tepidum, Chloroflexus auranticus, Chromatium vinosum, Chromatium tepidum Rhodospirillum rubrum, Rhodobacter capsulatus, Rhodopseudomonas palusris, Clostridium ljungdahlii, Clostridiuthermocellum, Panicum virgatum, Penicillium chrysogenum, Pichia pastoris, Saccharomyces cerevisiae, Yarrowia lipolytica, Schizosaccharomyces pombe, Pseudomonas fluorescens, Miscanthus giganteus, Zea mays*, or *Zymomonas mobilis*.

Yet other suitable organisms from which the host cell can be from include synthetic cells or cells produced by synthetic genomes as described in U.S. Patent Publication 2007/0264688, or 2007/0269862.

In other embodiments, the host cell is a CHO cell, a COS cell, a VERO cell, a BHK cell, a HeLa cell, a Cvl cell, an MDCK cell, a 293 cell, a 3T3 cell, or a PC12 cell.

In yet other embodiments, the host cell is an *E. coli* cell. In certain embodiments, the *E. coli* cell is a strain B, a strain C, a strain K, or a strain W *E. coli* cell.

In other embodiment, the host cell is a cyanobacterial host cell.

In some embodiments, a genetically engineered host cell described herein produces fatty acids and/or fatty acid derivatives at a titer of about 50 mg/L or more, about 100 mg/L or more, about 150 mg/L or more, about 200 mg/L or more, about 500 mg/L or more, or about 1000 mg/L or more.

In certain embodiments, the host cell overexpresses a nucleic acid sequence that encodes an ester synthase or a variant described herein. In certain embodiments, known genomic alteration techniques can be applied to change the features of one or more endogenous ester synthase enzymes such that they are overexpressed. In some embodiments, the method further includes transforming the host cell to overexpress a nucleic acid sequence that encodes a heterologous ester synthase described herein.

In certain embodiments, an endogenous thioesterase of the host cell, if present, is unmodified. In other embodiments, the host cell expresses an attenuated level of a thioesterase, a fatty acid degradation enzyme such as an acyl-CoA synthase, or both. In an exemplary embodiment, a thioesterase, an acyl-CoA synthase, or both, are functionally deleted.

In certain embodiments, the host cell overproduces a substrate described herein. For example, the host cell can be engineered to overproduce an alcohol substrate or a thioester substrate. In other embodiments, the host cell is engineered to produce or overproduce a free fatty acid, which can be converted into fatty esters using the methods described herein. In some embodiments, the method further includes modifying one or more endogenous ester synthase enzymes such that the host cell overexpresses those ester synthase enzymes. In alternate embodiments, the method includes transforming the host cell with a nucleic acid sequence that encodes an ester synthase, and the host cell produces a fatty acid and/or a fatty acid derivative described herein.

In other embodiments, the method further includes culturing the host cell in the presence of at least one substrate herein, which is expressed or overexpressed by the same host cell. In some embodiments, the substrate is a fatty thioester such as, for example, a fatty acyl-ACP or a fatty acyl-CoA. In other embodiments, the substrate is an alcohol or a free fatty acid, as described herein.

In some embodiments, the substrate is an alcohol. In some embodiments, the alcohol substrate is an exogenous alcohol that is introduced to the host cell. In other embodiments, the alcohol substrate is produced by the genetically engineered host cell. For example, the alcohol substrate, such as a fatty alcohol substrate, can be suitably produced by the host cell, which co-expresses or overexpresses one or more fatty aldehyde biosynthesis genes and/or one or more fatty alcohol biosynthesis genes. In an alternative embodiment, the alcohol substrate such as a fatty alcohol substrate is produced by a host cell, which co-expresses or overexpresses one or more acyl-ACP reductase genes and/or one or more fatty alcohol biosynthesis genes. Methods of producing fatty alcohols in a recombinant host cell or microorganism have been described in, for example, International Patent Publication No. WO/2010/042664, the disclosure of which is incorporated herein by reference.

In yet a further embodiment, the substrate is a free fatty acid. In certain embodiments, the free fatty acid is an undesirable side product, which can be converted by the host cell into a desirable fatty ester using the methods described herein.

In another aspect, the invention features a method of producing a fatty acid or a fatty acid derivative such as, for example, a fatty ester. The method includes contacting a substrate with (i) an ester synthase comprising the amino acid sequence of SEQ ID NO:18, 24, 25, or 26, or a variant thereof, or (ii) an ester synthase polypeptide encoded by a polynucleotide sequence having at least about 50% identity to the polynucleotide sequence of SEQ ID NO:27, 28, 29 or 30, or a variant thereof. In some embodiments, the method further includes isolating and/or purifying the fatty acid and/or fatty acid derivative.

In some embodiments, the ester synthase polypeptide comprises the amino acid sequence of SEQ ID NO:18, 24, 25, or 26, with one or more amino acid substitutions, additions, insertions or deletions, wherein the polypeptide has ester synthase and/or acyltransferase activity. In certain embodiments, the ester synthase polypeptide is modified wherein the polypeptide has an improved ester synthase and/or acyltransferase activity.

In some embodiments, the ester synthase polypeptide comprises the amino acid sequence of SEQ ID NO:18, 24, 25, or 26, with one or more non-conserved amino acid substitutions, wherein the polypeptide has ester synthase and/or acyltransferase activity. In some embodiments, the polypeptide comprises one or more conserved amino acid substitutions. In some embodiments, the polypeptide has about 1, 2, 3, 4, 5, 6, 7, 8, 9, 10, 15, 20, 30, 40, 50, 60, 70, 80, 90, 100, or more amino acid substitutions, additions, insertions, or deletions. In other embodiments, the polypeptide has improved ester synthase and/or acyltransferase activity. For example, the polypeptide is capable, or has improved capacity, of catalyzing the conversion of thioesters or free fatty acids to fatty esters, using alcohols as substrates.

In some embodiments, the polypeptide has an amino acid sequence that is at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to the amino acid sequence of SEQ ID NO:18, 24, 25, or 26. In some embodiments, the polypeptide has the amino acid sequence of SEQ ID NO:18, 24, 25, or 26.

In some embodiments, the polynucleotide sequence has at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to the polynucleotide sequence of SEQ ID NO:27, 28, 29, or 30. In some embodiment, the polynucleotide sequence is SEQ ID NO:27, 28, 29, or 30.

In another aspect, the invention features a free fatty acid produced by a method herein. In some embodiments, the free fatty acid comprises one or more points of branching, one or more points of unsaturation, and/or one or more cyclic moieties.

In another aspect, the invention features a fatty acid derivative produced by a method herein. In an exemplary embodiment, the fatty acid derivative is selected from a fatty acid methyl derivative, a fatty acid ethyl derivative, other fatty acid derivatives, and a combination thereof. In some embodiments, the carbon chain of the fatty acid derivative comprises one or more points of branching, one or more points of unsaturation, and/or one or more cyclic moieties.

In another aspect, the invention features a fatty ester produced by a method herein. In some embodiments, the fatty ester comprises an A side (i.e., the carbon chain attached to the carboxylate oxygen) and a B side (i.e., the carbon chain comprising the parent carboxylate). In some embodiments, the B side of the fatty ester includes a straight chain. In other embodiments, the B side of the fatty ester includes a branched chain. The branched chains may have one or more points of branching. In still other embodiments, the B side of the fatty ester comprises at least one cyclic moiety.

In some embodiments, the fatty acid ester is a fatty acid ethyl ester or a fatty acid methyl ester. In some embodiments, the fatty acid ester is at least about 4, 6, 8, 10, 12, 14, 18, or 20 carbons in length. The carbon chains comprising the A side or B side can be of any suitable length. In one embodiment, the A side of the ester is at least about 1, 2, 3, 4, 5, 6, 7, 8, 10, 12, 14, 16, or 18 carbons in length. The B side of the ester is at least about 4, 6, 8, 10, 12, 14, 16, 18, or 20 carbons in length. In some embodiments, the fatty ester is saturated. In other embodiments, the fatty ester is unsaturated. In other embodiments, the fatty ester is monounsaturated. If unsaturated, the A side and/or B side can have one or more points of unsaturation.

In some embodiments, the B side can have one double bond at one or more points in the carbon chain. In particular embodiments, the B side can have one double bond at position 7 of the carbon chain, numbering from the reduced end of the carbon chain. One of ordinary skill in the art will recognize that, in a fatty methyl ester, one end of the B side will have a methyl group, and the other end of the B side will have a carboxyl group (C(═O)O—). The end of the B side which is a methyl group is the reduced end of the carbon chain comprising the B side, thus, the double bond is at carbon 7 counting from the methyl group terminus of the B group (e.g., at between carbons 7 and 8 of the B group). The double bond can have any geometry, thus, the double bond in the B group can be cis or trans. Accordingly, in some embodiments, the fatty ester comprises a double bond at position 7 in the carbon chain (between $C_7$ and $C_8$) from the reduced end of the fatty ester.

In some embodiments, the fatty ester comprises one or more points of branching. In other embodiments, the fatty ester is linear and does not comprise any branched chains.

In another aspect, the invention features a genetically engineered microorganism comprising an exogenous control sequence stably incorporated into the genomic DNA of the microorganism upstream of a polynucleotide comprising a nucleotide sequence having at least about 50% identity to the nucleotide sequence of SEQ ID NO:27, 28, 29, or 30, wherein the microorganism produces an increased level of a fatty acid or fatty acid derivative relative to a wild type microorganism. In some embodiments, the polynucleotide is endogenous to the microorganism. In some embodiments, the polynucleotide sequence has at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to the polynucleotide sequence of SEQ ID NO:27, 28, 29, or 30. In some embodiment, the polynucleotide sequence is SEQ ID NO:27, 28, 29, or 30.

In other embodiments, the microorganism is genetically engineered to express a modified level of a gene encoding an ester synthase. In certain embodiments, the microorganism expresses a heterologous gene encoding an ester synthase or expresses an increased level of an endogenous ester synthase. In certain embodiments, an endogenous thioesterase of the microorganism, if present, is unmodified. In other embodiments, the microorganism expresses an attenuated level of an endogenous gene encoding a thioesterase. Alternatively, an endogenous thioesterase is functionally deleted. In particular embodiments, the thioesterase is encoded by tesA, tesA without leader sequence, tesB, fatB, fatB2, fatB3, fatA, or fatA1.

In some embodiments, the microorganism is genetically engineered to express an attenuated level of a fatty acid degradation enzyme relative to its level in a wild type microorganism. Exemplary fatty acid degradation enzymes include, without limitation, acyl-CoA synthase enzymes of EC 2.3.1.86 or EC 6.2.1.3. In particular embodiments, the microorganism is engineered to expresses an attenuated level of an acyl-CoA synthase encoded by fadD, fadK, BH3103, yhfL, pfl-4354, EAV15023, fadD1, fadD2, rpc_4074, fadDD35, fadDD22, faa3p or the gene encoding the protein ZP_01644857. In certain embodiments, the aforementioned fatty acid degradation enzyme, such as the acyl-CoA synthase gene, is functionally deleted such that the microorganism does not comprise an acyl-CoA synthase activity or functionality.

In certain other embodiments, the microorganism is engineered to express an attenuated level of a thioesterase, a fatty acid degradation enzyme such as an acyl-CoA synthase, or both. In further embodiments, an endogenous thioesterase, a fatty acid degradation enzyme, or both, are functionally deleted. In particular embodiments, the microorganism has no detectable thioesterase or acyl-CoA synthase activity. In some embodiments, the microorganism is capable of producing fatty acids and/or derivatives thereof.

In other embodiments, the microorganism is genetically engineered to express, relative to a wild type microorganism, a decreased level of at least one of a gene encoding an acyl-CoA dehydrogenase, a gene encoding an outer membrane protein receptor, and a gene encoding a transcriptional regulator of fatty acid biosynthesis. In some embodiments, one or more of a gene encoding an acyl-CoA dehydrogenase, a gene encoding an outer membrane protein receptor, and a gene encoding a transcriptional regulator of fatty acid biosynthesis are functionally deleted. In some embodiments, the gene encoding an acyl-CoA dehydrogenase is fadE. In some embodiments, the gene encoding an outer membrane protein receptor is one that encodes a receptor for ferrichrome, colicin M, phage T1, phage T5, or phage phi80. In certain embodiments, the gene encoding an outer membrane protein receptor is fhuA (also known as tonA). Yet in other embodiments, the gene encoding a transcriptional regulator of fatty acid biosynthesis is fabR.

In some embodiments, the microorganism is a bacterium. In certain embodiments, the bacterium is a Gram-negative or a Gram-positive bacterium.

In some embodiments, the microorganism is a mycobacterium selected from the group consisting of *Mycobacterium smegmatis, Mycobacterium abscessus, Mycobacterium avium, Mycobacterium bovis, Mycobacterium tuberculosis, Mycobacterium leprae, Mycobacterium marinum,* and *Mycobacterium ulcerans*. In other embodiments, the bacterium is *Nocardia* sp. NRRL 5646, *Nocardia farcinica, Streptomyces griseus, Salinispora arenicola,* or *Clavibacter michiganenesis*.

In some embodiments, the microorganism is selected from the group consisting of *Acinetobacter, Alcanivorax, Alcaligenes, Arabidopsis, Fundibacter, Marinobacter, Mus musculus, Pseudomonas,* or *Simmodsia*.

In particular embodiments, the microorganism is selected from the group consisting of algae, cyanobacterium, green-sulfur bacterium (including, e.g., *Chlorobium, Clathrochloris, Prosthecochloris*), green non-sulfur bacterium (including, e.g., *Chloroflexus, chloronema, Oscillochloris, Heliothrix, Herpetosiphon, Roseiflexus,* and *Termomicrobium*), purple sulfur bacterium (including, e.g., *Allochromatium, Chromatium, Halochromatium, Isochromatium, Marichromatium, Rhodovulum, Thermochromatium, Thiocapsa, Thiorhodococcus,* and *Thiocystis*), purple non-sulfur bacterium (including, e.g., *Phaeospirillum, Rhodobac, Rhodobacter, Rhodomicrobium, Rhodopila, Rhodopseudomonas, Rhodothalassium, Rhodovibrio, Roseospira*), or extremophile.

In certain other embodiments, the microorganism is selected from the group consisting of: *Arabidopsis thaliana, Botryococcus braunii, Chlamydomonas reinhardtii, Dunaliela salina, Synechococcus* Sp. PCC 7002, *Synechococcus* Sp. PCC 7942, *Synechocystis* Sp. PCC 6803, *Thermosynechococcus elongatus* BP-1, *Chlorobium tepidum, Chloroflexus auranticus, Chromatium vinosum, Chromatium tepidum Rhodospirillum rubrum, Rhodobacter capsulatus, Rhodopseudomonas palusris, Clostridium ljungdahlii, Clostridiuthermocellum, Panicum virgatum, Penicillium chrysogenum, Pichia pastoris, Saccharomyces cerevisiae, Yarrowia lipolytica, Schizosaccharomyces pombe, Pseudomonas fluorescens, Miscanthus giganteus, Zea mays,* or *Zymomonas mobilis*.

In some embodiments, the microorganism is an oleaginous yeast, for example, a *Yarrowia, Candida, Rhodotorula, Rhodosporidium, Cryptococcus, Trichosporon,* or *Lipomyces*. In certain embodiments, the microorganism is a *Rhodosporidium toruloide, Lipomyces starkeyii, L. Lipoferus, Candida revkaufi, C. pulcherrima, C. Tropicalis, C. utilis, Trichosporon pullas, T. cutaneum, Rhodotorula glutinous, R. Garminis,* and *Yarrowia lipolytica* (formally classified as *Candida lipolytica*). In particular embodiments, the microorganism is *Yarrowia lipolytica* strain ATCC #20362, ATCC #8862, ATCC #18944, ATCC #76982 and/or LGAM S(7)1 (Papanikolaou S., and Aggelis G., Bioresour. Technol., 82(1):43-9, 2002).

In another aspect, the invention features a fatty acid or fatty acid derivative produced by any of the methods or any of the microorganisms described herein, or a composition comprising a fatty acid or derivative thereof produced by any of the methods or any of the microorganisms described herein.

In some embodiments, the fatty acid or fatty acid derivative has a $\delta^{13}C$ of about −15.4 or greater. In certain embodiments, the fatty acid or fatty acid derivative has a $\delta^{13}C$ of about −15.4 to about −10.9, or of about −13.92 to about −13.84.

In some embodiments, the fatty acid or fatty acid derivative has an $f_m{}^{14}C$ of at least about 1.003. In certain embodiments, the fatty acid or fatty acid derivative has an $f_m{}^{14}C$ of at least about 1.01 or at least about 1.5. In some embodiments, the fatty acid or fatty acid derivative has an $f_m{}^{14}C$ of about 1.111 to about 1.124.

In another aspect, the invention features a biofuel composition comprising the fatty acids or fatty acid derivatives produced by any of the methods or by any of the microorganisms described herein.

In any of the aspects described herein, a fatty acid or fatty acid derivative is produced in a host cell or a microorganism described herein from a carbon source, including, for example, an alcohol, a free fatty acid, or a thioester.

In any of the aspects described herein, carbon source substrates can be, for example, alcohol substrates, thioester substrates, and free fatty acids. Suitable alcohol substrates include short-chain alcohols such as methanol, ethanol, propanol (isopropanol), butanol, pentanol, hexanol, heptanol, and the like, as well as various long-chain alcohols such as fatty alcohols, for example, octanol, tetradecanol, hexadecanol, hexadecenol, octadecenol, and others. Furthermore, the invention pertains to converting methanol, ethanol, propanol, butanol, pentanol, hexanol, heptanol, and/or other alcohol substrates to fatty acid derivatives, such as, for example, fatty esters, using the genetically engineered production host. In certain embodiments, ethanol is converted by a suitably-engineered production host. Preferably, one or more fatty acid ethyl esters and/or free fatty acids are produced. In certain other embodiments, methanol is converted by a suitably-engineered production host. Preferably, one or more fatty acid methyl esters and/or free fatty acids are produced. In yet other embodiments, butanol is converted by a suitably-engineered production host. In yet other embodiments, a mixture of ethanol, methanol, and/or other suitable alcohol substrates can be converted to a mixture of fatty acids and/or fatty acid derivatives by culturing one or more of the production hosts genetically engineered according to the methods herein under conditions that allow the production of such free fatty acids and/or fatty acid derivatives. For example, one or more free fatty acids, one or more fatty acid ethyl esters, and/or one or more fatty acid methyl esters are produced.

In any of the aspects described herein, suitable carbon source substrates can be free fatty acids and thioesters. For example, the free fatty acid can comprise a branched carbon chain. Alternatively, the free fatty acid can comprise a linear carbon chain. In some embodiments, the free fatty acid can comprise a cyclic group, or one or more points of unsaturation. In some embodiments, the thioester substrate is a fatty acyl-CoA or fatty acyl-ACP. In yet another aspect, the invention features a method of producing fatty esters from the free fatty acids in the waste stream of a conventional fatty ester production process.

In any of the aspects described herein, the ester synthase polypeptide can be about 200 amino acids to about 2,000 amino acids in length, for example, from about 250 to about 1,500 amino acid residues in length, from about 300 to about 1,200 amino acid residues in length, from about 350 to about 1,000 amino acid residues in length, from about 400 to about 800 amino acid residues in length, or from about 450 to about 600 amino acid residues in length. In certain embodiments, the ester synthase polypeptide is about 300 amino acid residues in length or longer, for example, about 400 amino acid residues in length or longer, or about 450 amino acid residues in length or longer. In certain related embodiments, the ester synthase polypeptide is about 1,000 amino acid residues in length or shorter, for example, about 800 amino acid residues in length or shorter, about 700 amino acid residues in length or shorter, or about 600 amino acid residues in length or shorter. An exemplary ester synthase of the invention is about 500 amino acid residues in length.

The drawings and examples provided herein are intended solely to illustrate the features of the present invention. They are not intended to be limiting.

BRIEF DESCRIPTION OF THE DRAWINGS

FIG. 1A is a diagram illustrating a typical biosynthetic pathway known in the art (see, e.g., WO2007/136762, the disclosures of which are incorporated by reference herein), which produces fatty acid and/or fatty acid derivatives depending upon the substrates provided. FIG. 1B is a diagram exemplifying an alternative and more efficient pathway of the present invention.

FIG. 2 depicts the sequence of E. coli spc ribosomal protein operon promoter Pspc (SEQ ID NO:13).

FIG. 3 depicts a bacterial expression plasmid, pDS33.ES9 (SEQ ID NO:22), in which expression of an ester synthase gene from Marinobacter hydrocarbonoclasticus DSM 8798 (GenBank Accession No. ABO21021) is under the control of the E. coli spc ribosomal protein operon promoter Pspc (SEQ ID NO:13).

FIG. 4 depicts a bacterial expression plasmid, pDS57 (SEQ ID NO:23) wherein the expression of an ester synthase gene is under the control of a Trc promoter.

FIG. 11 depicts fatty acid methyl ester production titers by ES1, ES2, ES3, and ES4, the homologs of ES9, in accordance with Examples 12-13, which converted acyl-ACPs and methanol into methyl esters.

FIG. 16 depicts various ester synthase and homolog amino acid and polynucleotide sequences. This list also includes various codon optimized polynucleotide sequences encoding the four homologs ES1, ES2, ES3, and ES4.

FIG. 17 depicts other sequences of enzymes that can be used in connection with the present invention.

DETAILED DESCRIPTION OF THE INVENTION

Figure 5:
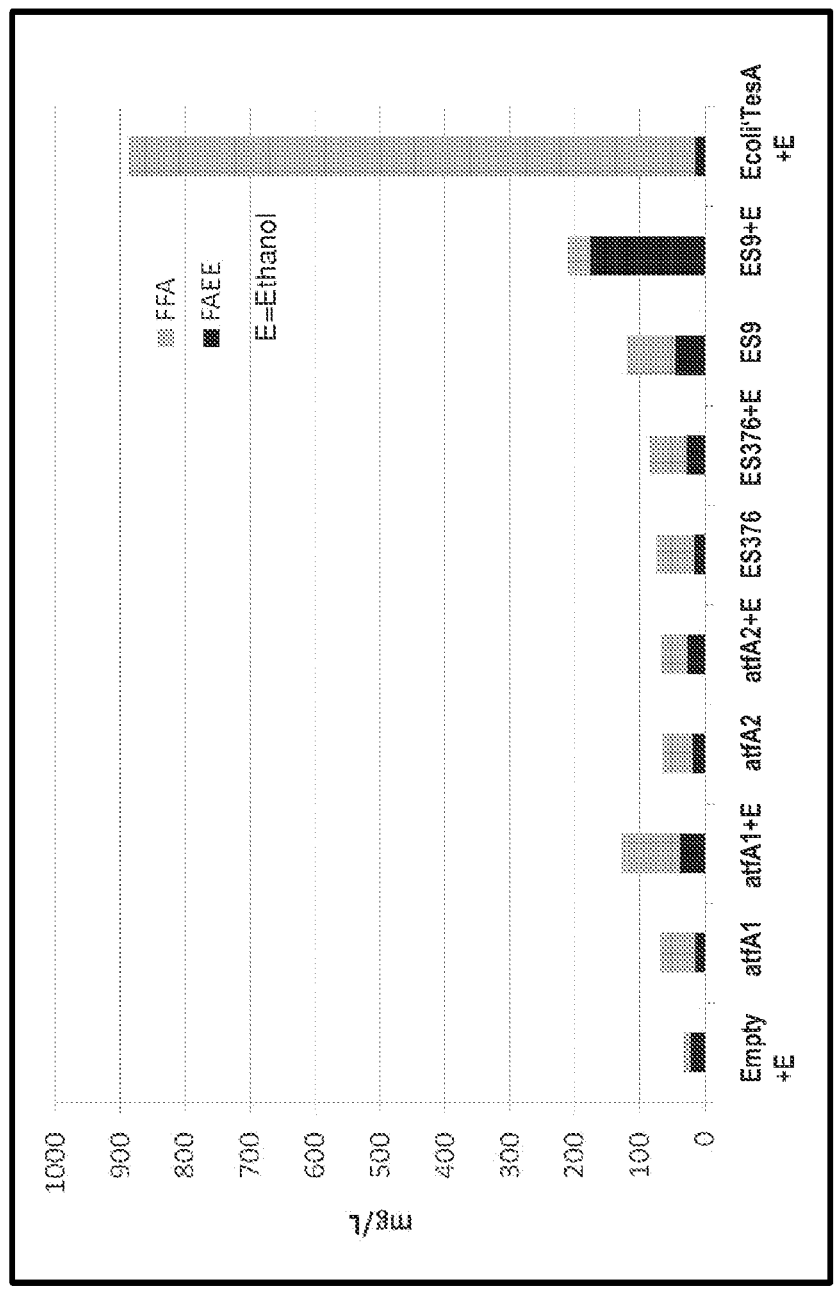
FIG. 5 depicts the amount of free fatty acid (FFA) and fatty acyl ethyl ester (FAEE) produced by each culture in accordance with Example 6, without co-expression of an acyl-CoA synthase or a thioesterase, in the presence and absence of ethanol in microwell plates. ES9 generated nearly 200 mg/L FAEE in the presence of ethanol, but only a small quantity (<20%) of FFA. The other ester synthases, including ES8, atfA1 and atfA2, produced substantially lower amounts of FAEE in the presence of ethanol, accompanied by a higher proportion of FFA. The culture E. coli 'tesA produced higher overall titers of FFA and FAEE in the presence of ethanol, but the amount of FFA was significantly greater than the amount of FAEE generated.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein, including GenBank database sequences, are incorporated by reference in their entirety. In case of conflict, the present specification, including definitions, will control. In addition, the materials, methods, and examples are illustrative only and not intended to be limiting.

Other features and advantages of the invention will be apparent from the following detailed description, and from the claims.

DEFINITIONS

The articles "a" and "an" are used herein to refer to one or to more than one (i.e., to at least one) of the grammatical object of the article. By way of example, "an element" means one element or more than one element.

As used herein, an "aldehyde biosynthetic gene" or an "aldehyde biosynthetic polynucleotide" is a nucleic acid that encodes an aldehyde biosynthetic polypeptide.

As used herein, an "aldehyde biosynthetic polypeptide" is a polypeptide that is a part of the biosynthetic pathway of an aldehyde. Such polypeptides can act on a biological substrate to yield an aldehyde. In some instances, the aldehyde biosynthetic polypeptide has reductase activity.

As used herein, the term "attenuate" means to weaken, reduce, or diminish. For example, a polypeptide can be attenuated by modifying the polypeptide to reduce its activity (e.g., by modifying a nucleotide sequence that encodes the polypeptide).

As used herein, the term "biocrude" refers to a product derived from biomass, biomass derivatives, or other biological sources that, like petroleum crude, can be converted into other fuels. For example, biocrude can be converted into gasoline, diesel, jet fuel, or heating oil. Moreover, biocrude, like petroleum crude, can be converted into other industrially useful chemicals for use in, for example, pharmaceuticals, cosmetics, consumer goods, industrial processes, and the like.

Biocrude may include, for example, hydrocarbons, hydrocarbon products, fatty acid esters, and/or aliphatic ketones. In a preferred embodiment, biocrude is comprised of hydrocarbons, for example aliphatic (e.g., alkanes, alkenes, alkynes) or aromatic hydrocarbons.

As used herein, the term "biodiesel" means a biofuel that can be a substitute of diesel, which is derived from petroleum. Biodiesel can be used in internal combustion diesel engines in either a pure form, which is referred to as "neat" biodiesel, or as a mixture in any concentration with petroleum-based diesel. In one embodiment, biodiesel can include esters or hydrocarbons, such as aldehydes, alkanes, or alkenes.

As used herein, the term "biofuel" refers to any fuel derived from biomass, biomass derivatives, or other biological sources. Biofuels can be substituted for petroleum based fuels. For example, biofuels are inclusive of transportation fuels (e.g., gasoline, diesel, jet fuel, etc.), heating fuels, and electricity-generating fuels. Biofuels are a renewable energy source.

As used herein, the term "biomass" refers to a carbon source derived from biological material. Biomass can be converted into a biofuel. One exemplary source of biomass is plant matter. For example, corn, sugar cane, or switchgrass can be used as biomass. Another non-limiting example of biomass is animal matter, for example cow manure. Biomass also includes waste products from industry, agriculture, forestry, and households. Examples of such waste products that can be used as biomass are fermentation waste, straw, lumber, sewage, garbage, and food leftovers. Biomass also includes sources of carbon, such as carbohydrates (e.g., monosaccharides, disaccharides, or polysaccharides).

As used herein, the phrase "carbon source" refers to a substrate or compound suitable to be used as a source of carbon for prokaryotic or simple eukaryotic cell growth. Carbon sources can be in various forms, including, but not limited to polymers, carbohydrates, acids, alcohols, aldehydes, ketones, amino acids, peptides, and gases (e.g., CO and $CO_2$). These include, for example, various monosaccharides, such as glucose, fructose, mannose, and galactose; oligosaccharides, such as fructo-oligosaccharide and galacto-oligosaccharide; polysaccharides such as xylose and arabinose; disaccharides, such as sucrose, maltose, and turanose; cellulosic material, such as methyl cellulose and sodium carboxymethyl cellulose; saturated or unsaturated fatty acid esters, such as succinate, lactate, and acetate; alcohols, such as methanol, ethanol, propanol, or mixtures thereof. The carbon source can also be a product of photosynthesis, including, but not limited to, glucose. A preferred carbon source is biomass. Another preferred carbon source is glucose.

As used herein, a "cloud point lowering additive" is an additive added to a composition to decrease or lower the cloud point of a solution.

As used herein, the phrase "cloud point of a fluid" means the temperature at which dissolved solids are no longer completely soluble. Below this temperature, solids begin precipitating as a second phase giving the fluid a cloudy appearance. In the petroleum industry, cloud point refers to the temperature below which a solidified material or other heavy hydrocarbon crystallizes in a crude oil, refined oil, or fuel to form a cloudy appearance. The presence of solidified materials influences the flowing behavior of the fluid, the tendency of the fluid to clog fuel filters, injectors, etc., the accumulation of solidified materials on cold surfaces (e.g., a pipeline or heat exchanger fouling), and the emulsion characteristics of the fluid with water.

A nucleotide sequence is "complementary" to another nucleotide sequence if each of the bases of the two sequences matches (e.g., is capable of forming Watson Crick base pairs). The term "complementary strand" is used herein interchangeably with the term "complement". The complement of a nucleic acid strand can be the complement of a coding strand or the complement of a non-coding strand.

The terms "comprising," "having," "including," and "containing" are to be construed as open-ended terms (e.g., meaning "including, but not limited to,") unless otherwise noted.

As used herein, the term "conditions sufficient to allow expression" means any conditions that allow a host cell or production host to produce a desired product, such as a polypeptide, acyl-CoA, fatty acid derivative (e.g., fatty acids, hydrocarbons, fatty alcohols, fatty esters, etc.), or other product described herein. Suitable conditions include, for example, fermentation conditions. Fermentation conditions can comprise many parameters. Exemplary conditions include temperature ranges, levels of aeration, and media composition. Each of these conditions, individually and in combination, allows the host cell to grow.

Exemplary culture media include broths or gels. Generally, the medium includes a carbon source, such as glucose, fructose, cellulose, or the like, that can be metabolized by a host cell directly. In addition, enzymes can be used in the medium to facilitate the mobilization (e.g., the depolymerization of starch or cellulose to fermentable sugars) and subsequent metabolism of the carbon source.

To determine if conditions are sufficient to allow expression, a host cell can be cultured, for example, for about 4, 8, 12, 24, 36, or 48 hours. During and/or after culturing, samples can be obtained and analyzed to determine if the conditions allow expression. For example, the host cells in the sample or the medium in which the host cells were grown can be tested for the presence of a desired product. When testing for the presence of a product, assays, such as, but not limited to, TLC, HPLC, GC/FID, GC/MS, LC/MS, MS, can be used.

As used herein, "conditions that permit product production" refers to any fermentation conditions that allow a production host to produce a desired product, such as acyl-CoA or fatty acid derivatives (e.g., fatty acids, hydrocarbons, fatty alcohols, waxes, or fatty esters). Fermentation conditions usually comprise many parameters. Exemplary conditions include, but are not limited to, temperature ranges, levels of aeration, and media composition. Each of these conditions, individually and/or in combination, allows the production host to grow.

Exemplary media include broths and/or gels. Generally, a suitable medium includes a carbon source (e.g., glucose, fructose, cellulose, etc.) that can be metabolized by the microorganism directly. In addition, enzymes can be used in the medium to facilitate the mobilization (e.g., the depolymerization of starch or cellulose to fermentable sugars) and subsequent metabolism of the carbon source.

To determine if the fermentation conditions permit product production, the production host can be cultured for about 4, 8, 12, 24, 36, or 48 hours. During culturing or after culturing, samples can be obtained and analyzed to determine if the fermentation conditions have permitted product production. For example, the production hosts in the sample or the medium in which the production hosts are grown can be tested for the presence of the desired product. Exemplary assays, such as TLC, HPLC, GC/FID, GC/MS, LC/MS, MS, as well as those provided herein, can be used identify and quantify the presence of a product.

As used herein, "conservative amino acid substitution" means an amino acid residue is replaced with an amino acid residue having a similar side chain. Families of amino acid residues having similar side chains have been defined in the art. These families include amino acids with basic side chains (e.g., lysine, arginine, and histidine), acidic side chains (e.g., aspartic acid and glutamic acid), uncharged polar side chains (e.g., glycine, asparagine, glutamine, serine, threonine, tyrosine, and cysteine), nonpolar side chains (e.g., alanine, valine, leucine, isoleucine, proline, phenylalanine, methionine, and tryptophan), beta-branched side chains (e.g., threonine, valine, and isoleucine), and aromatic side chains (e.g., tyrosine, phenylalanine, tryptophan, and histidine).

It is understood that the polypeptides described herein may have additional conservative or non-essential amino acid substitutions, which do not have a substantial effect on the polypeptide functions. Whether or not a particular substitution will be tolerated (e.g., will not adversely affect desired biological properties, such as decarboxylase activity) can be determined as described in Bowie et al., *Science* 247:1306 1310 (1990).

As used herein, "control element" means a transcriptional control element. Control elements include promoters and enhancers. The term "promoter element," "promoter," or "promoter sequence" refers to a DNA sequence that functions as a switch that activates the expression of a gene. If the gene is activated, it is said to be transcribed or participating in transcription. Transcription involves the synthesis of mRNA from the gene. A promoter, therefore, serves as a transcriptional regulatory element and also provides a site for initiation of transcription of the gene into mRNA. Control elements interact specifically with cellular proteins involved in transcription (Maniatis et al., *Science* 236:1237 (1987)).

As used herein, the term "functional deletion," or "knockout" means modifying or inactivating a polynucleotide sequence that encodes a target protein in order to reduce or eliminate the function of the target protein. A polynucleotide deletion can be performed by methods well known in the art (See, e.g., Datsenko et al., *Proc. Nat. Acad. Sci. USA*, 97:6640-45 (2000) or International Patent Application Nos. PCT/US2007/011923 and PCT/US2008/058788).

As used herein, the term "endogenous" means a polynucleotide that is in the cell and was not introduced into the cell using recombinant genetic engineering techniques. For example, a gene that was present in the cell when the cell was originally isolated from nature. A polynucleotide is still considered endogenous if the control sequences, such as a promoter or enhancer sequences which activate transcription or translation, have been altered through recombinant techniques.

As used herein, the term "ester synthase" means a peptide capable of producing fatty esters. More specifically, an ester synthase is a peptide which converts a thioester to a fatty ester. In a preferred embodiment, the ester synthase converts a thioester (e.g., acyl-CoA) to a fatty ester.

In an alternate embodiment, an ester synthase uses a thioester and an alcohol as substrates to produce a fatty ester. Ester synthases are capable of using short and long chain thioesters as substrates. In addition, ester synthases are capable of using short and long chain alcohols as substrates.

Non-limiting examples of ester synthases are wax synthases, wax-ester synthases, acyl CoA: alcohol transacylases, acyltransferases, and fatty acyl-coenzyme A:fatty alcohol acyltransferases. Exemplary ester synthases are classified in enzyme classification number EC 2.3.1.75. A number of these enzymes, as well as other useful enzymes for making the products described herein, have been disclosed in, for example, International Patent Application Nos. PCT/US2007/011923 and PCT/US2008/058788, which are incorporated herein by reference.

As used herein, the term "exogenous" means a polynucleotide that does not originate from a particular cell as found in nature. For example, "exogenous polynucleotide" could refer to a polynucleotide that was inserted within the genomic polynucleotide sequence of a microorganism or to an extra chromosomal polynucleotide that was introduced into the microorganism. Thus, a non-naturally-occurring polynucleotide is considered to be exogenous to a cell once introduced into the cell. A polynucleotide that is naturally-occurring can also be exogenous to a particular cell. For example, an entire polynucleotide isolated from a first cell can be an exogenous polynucleotide with respect to a second cell if that polynucleotide from the first cell is introduced into the second cell.

As used herein, the term "fatty acid" means a carboxylic acid having the formula RCOOH. R represents an aliphatic group, preferably an alkyl group. R can comprise between about 4 and about 22 carbon atoms. Fatty acids can be saturated, monounsaturated, or polyunsaturated. In a preferred embodiment, the fatty acid is made from a fatty acid biosynthetic pathway.

As used herein, the term "fatty acid biosynthetic pathway" means a biosynthetic pathway that produces fatty acids. The fatty acid biosynthetic pathway includes fatty acid enzymes that can be engineered, as described herein, to produce fatty acids, and in some embodiments can be expressed with additional enzymes to produce fatty acids having desired carbon chain characteristics.

As used herein, the term "fatty acid degradation enzyme" means an enzyme involved in the breakdown or conversion of a fatty acid or fatty acid derivative into another product. A nonlimiting example of a fatty acid degradation enzyme is an acyl-CoA synthase. A number of these enzymes, as well as other useful enzymes for making the products described herein, have been disclosed in, for example, International Patent Application Nos. PCT/US2007/011923 and PCT/US2008/058788, which are incorporated herein by reference. Additional examples of fatty acid degradation enzymes are described herein.

As used herein, the term "fatty acid derivative" means products made in part from the fatty acid biosynthetic pathway of the production host organism. "Fatty acid derivative" also includes products made in part from acyl-ACP or acyl-ACP derivatives. The fatty acid biosynthetic pathway includes fatty acid synthase enzymes which can be engineered as described herein to produce fatty acid derivatives, and in some examples can be expressed with additional enzymes to produce fatty acid derivatives having desired carbon chain characteristics. Exemplary fatty acid derivatives include for example, fatty acids, acyl-CoAs, fatty aldehydes, short and long chain alcohols, hydrocarbons, fatty alcohols, ketones, and esters (e.g., waxes, fatty acid esters, or fatty esters).

As used herein, the term "fatty acid derivative enzymes" means all enzymes that may be expressed or overexpressed in the production of fatty acid derivatives. These enzymes are collectively referred to herein as fatty acid derivative enzymes. These enzymes may be part of the fatty acid biosynthetic pathway. Non-limiting examples of fatty acid derivative enzymes include fatty acid synthases, thioesterases, acyl-CoA synthases, acyl-CoA reductases, alcohol dehydrogenases, alcohol acyltransferases, carboxylic acid reductases, fatty alcohol-forming acyl-CoA reductase, ester synthases, aldehyde biosynthetic polypeptides, and alkane biosynthetic polypeptides. Fatty acid derivative enzymes convert a substrate into a fatty acid derivative. In some examples, the substrate may be a fatty acid derivative which the fatty acid derivative enzyme converts into a different fatty acid derivative. A number of these enzymes, as well as other useful enzymes for making the products described herein, have been disclosed in, for example, International Patent Application Nos. PCT/US2007/011923 and PCT/US2008/058788, which are incorporated herein by reference.

As used herein, "fatty acid enzyme" means any enzyme involved in fatty acid biosynthesis. Fatty acid enzymes can be expressed or overexpressed in host cells to produce fatty acids. Non-limiting examples of fatty acid enzymes include fatty acid synthases and thioesterases. A number of these enzymes, as well as other useful enzymes for making the products described herein, have been disclosed in, for example, International Patent Application Nos. PCT/US2007/011923 and PCT/US2008/058788, which are incorporated herein by reference.

As used herein, the term "fatty alcohol" means an alcohol having the formula ROH. In a preferred embodiment, the fatty alcohol is any alcohol made from a fatty acid or fatty acid derivative.

In one embodiment, the R group is at least about 5, 6, 7, 8, 9, 10, 11, 12, 13, 14, 15, 16, 17, 18, 19, or 20 carbons in length. R can be straight or branched chain. The branched chains may have one or more points of branching. In addition, the branched chains may include cyclic branches. Furthermore, R can be saturated or unsaturated. If unsaturated, the R can have one or more points of unsaturation.

In one embodiment, the fatty alcohol is produced biosynthetically. Fatty alcohols have many uses. For example, fatty alcohols can be used to produce many specialty chemicals. For example, fatty alcohols are used as a biofuel; as solvents for fats, waxes, gums, and resins; in pharmaceutical salves, emollients and lotions; as lubricating-oil additives; in detergents and emulsifiers; as textile antistatic and finishing agents; as plasticizers; as nonionic surfactants; and in cosmetics, for examples as thickeners.

As used herein, the term "fatty ester" means an ester. In a preferred embodiment, a fatty ester is any ester made from a fatty acid to produce, for example, a fatty acid ester. In one embodiment, a fatty ester contains an A side (i.e., the carbon chain attached to the carboxylate oxygen) and a B side (i.e., the carbon chain comprising the parent carboxylate). In a preferred embodiment, when the fatty ester is derived from the fatty acid biosynthetic pathway, the A side is contributed by an alcohol, and the B side is contributed by a fatty acid. Any alcohol can be used to form the A side of the fatty esters. For example, the alcohol can be derived from the fatty acid biosynthetic pathway. Alternatively, the alcohol can be produced through non-fatty acid biosynthetic pathways. Moreover, the alcohol can be provided exogenously. For example, the alcohol can be supplied in the fermentation broth in instances where the fatty ester is produced by an organism that can also produce the fatty acid. Alternatively, a carboxylic acid, such as a fatty acid or acetic acid, can be supplied exogenously in instances where the fatty ester is produced by an organism that can also produce alcohol.

The carbon chains comprising the A side or B side can be of any length. In one embodiment, the A side of the ester is at least about 1, 2, 3, 4, 5, 6, 7, 8, 10, 12, 14, 16, or 18 carbons in length. The B side of the ester is at least about 4, 6, 8, 10, 12, 14, 16, 18, 20, 22, 24, or 26 carbons in length. The A side and/or the B side can be straight or branched chain. The branched chains may have one or more points of branching. In addition, the branched chains may include cyclic branches. Furthermore, the A side and/or B side can be saturated or unsaturated. If unsaturated, the A side and/or B side can have one or more points of unsaturation.

In one embodiment, the fatty ester is produced biosynthetically. In this embodiment, first the fatty acid is "activated." Non-limiting examples of "activated" fatty acids are acyl-CoA, acyl-ACP, and acyl phosphate. Acyl-CoA can be a direct product of fatty acid biosynthesis or degradation. In addition, acyl-CoA can be synthesized from a free fatty acid, a CoA, or an adenosine nucleotide triphosphate (ATP). An example of an enzyme which produces acyl-CoA is acyl-CoA synthase.

After the fatty acid is activated, it can be readily transferred to a recipient nucleophile. Exemplary nucleophiles are alcohols, thiols, or phosphates.

In one embodiment, the fatty ester is a wax. The wax can be derived from a long chain alcohol and a long chain fatty acid. In another embodiment, the fatty ester can be derived from a fatty acyl-thioester and an alcohol. In another embodiment, the fatty ester is a fatty acid thioester, for example fatty acyl Coenzyme A (CoA). In other embodiments, the fatty ester is a fatty acyl panthothenate, an acyl carrier protein (ACP), or a fatty phosphate ester. Fatty esters have many uses. For example, fatty esters can be used as biofuels, surfactants, or formulated into additives that provide lubrication and other benefits to fuels and industrial chemicals.

As used herein, "fraction of modern carbon" or "$f_M$" has the same meaning as defined by National Institute of Standards and Technology (NIST) Standard Reference Materials (SRMs) 4990B and 4990C, known as oxalic acids standards HOxI and HOxII, respectively. The fundamental definition relates to 0.95 times the $^{14}C/^{12}C$ isotope ratio HOxI (referenced to AD 1950). This is roughly equivalent to decay-corrected pre-Industrial Revolution wood. For the current living biosphere (e.g., plant material), $f_M$ is approximately 1.1.

Calculations of "homology" between two sequences can be performed as follows. The sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, the length of a reference sequence that is aligned for comparison purposes is at least about 30%, preferably at least about 40%, more preferably at least about 50%, even more preferably at least about 60%, and even more preferably at least about 70%, at least about 80%, at least about 90%, or about 100% of the length of the reference sequence. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein, amino acid or nucleic acid "identity" is equivalent to amino acid or nucleic acid "homology"). The percent identity between the two sequences is a function of the number of identical positions shared by the sequences, taking into account the number of gaps and the length of each gap, which need to be introduced for optimal alignment of the two sequences.

The comparison of sequences and determination of percent homology between two sequences can be accomplished using a mathematical algorithm. In a preferred embodiment, the percent homology between two amino acid sequences is determined using the Needleman and Wunsch (1970), *J. Mol. Biol.* 48:444 453, algorithm that has been incorporated into the GAP program in the GCG software package, using either a Blossum 62 matrix or a PAM250 matrix, and a gap weight of 16, 14, 12, 10, 8, 6, or 4 and a length weight of 1, 2, 3, 4, 5, or 6. In yet another preferred embodiment, the percent homology between two nucleotide sequences is determined using the GAP program in the GCG software package, using a NWSgapdna. CMP matrix and a gap weight of about 40, 50, 60, 70, or 80 and a length weight of about 1, 2, 3, 4, 5, or 6. A particularly preferred set of parameters (and the one that should be used if the practitioner is uncertain about which parameters should be applied to determine if a molecule is within a homology limitation of the claims) are a Blossum 62 scoring matrix with a gap penalty of 12, a gap extend penalty of 4, and a frameshift gap penalty of 5.

Other methods for aligning sequences for comparison are well known in the art. Various programs and alignment algorithms are described in, for example, Smith & Waterman, *Adv. Appl. Math.* 2:482 (1981); Pearson & Lipman, *Proc. Natl. Acad. Sci. USA* 85:2444 (1988); Higgins & Sharp, *Gene* 73:237 244 (1988); Higgins & Sharp, *CABIOS* 5:151-153 (1989); Corpet et al., *Nucleic Acids Research* 16:10881-10890 (1988); Huang et cll., *CABIOS* 8:155-165 (1992); and Pearson et al., *Methods in Molecular Biology* 24:307-331 (1994). and Altschul et al., *J. Mol. Biol.* 215:403-410 (1990).

As used herein, a "host cell" is a cell used to produce a product described herein (e.g., an aldehyde or alkane). A host cell can be modified to express or overexpress selected genes or to have attenuated expression of selected genes. Non-limiting examples of host cells include plant, animal, human, bacteria, cyanobacteria, yeast, or filamentous fungi cells.

As used herein, the term "hybridizes under low stringency, medium stringency, high stringency, or very high stringency conditions" describes conditions for hybridization and washing. Guidance for performing hybridization reactions can be found, for example, in *Current Protocols in Molecular Biology*, John Wiley & Sons, N.Y. (1989), 6.3.1-6.3.6. Aqueous and nonaqueous methods are described in that reference and either method can be used. Specific hybridization conditions referred to herein are as follows: 1) low stringency hybridization conditions in 6× sodium chloride/sodium citrate (SSC) at about 45° C., followed by two washes in 0.2×SSC, 0.1% SDS at least at 50° C. (the temperature of the washes can be increased to 55° C. for low stringency conditions); 2) medium stringency hybridization conditions in 6×SSC at about 45° C., followed by one or more washes in 0.2×SSC, 0.1% SDS at 60° C.; 3) high stringency hybridization conditions in 6×SSC at about 45° C., followed by one or more washes in 0.2×SSC, 0.1% SDS at 65° C.; and preferably 4) very high stringency hybridization conditions are 0.5M sodium phosphate, 7% SDS at 65° C., followed by one or more washes at 0.2×SSC, 1% SDS at 65° C. Very high stringency conditions (4) are the preferred conditions unless otherwise specified.

The term "isolated" as used herein with respect to nucleic acids, such as DNA or RNA, refers to molecules separated from other DNAs or RNAs, respectively, that are present in the natural source of the nucleic acid. Moreover, an "isolated nucleic acid" includes nucleic acid fragments, such as fragments that are not naturally occurring. The term "isolated" is also used herein to refer to polypeptides, which are isolated from other cellular proteins, and encompasses both purified endogenous polypeptides and recombinant polypeptides. The term "isolated" as used herein also refers to a nucleic acid or polypeptide that is substantially free of cellular material, viral material, or culture medium when produced by recombinant DNA techniques. The term "isolated" as used herein also refers to a nucleic acid or polypeptide that is substantially free of chemical precursors or other chemicals when chemically synthesized.

As used herein, the "level of expression of a gene in a cell" refers to the level of mRNA, pre-mRNA nascent transcript(s), transcript processing intermediates, mature mRNA(s), and/or degradation products encoded by the gene in the cell.

As used herein, the term "microorganism" means prokaryotic and eukaryotic microbial species from the domains Archaea, Bacteria and Eucarya, the latter including yeast and filamentous fungi, protozoa, algae, or higher Protista. The term "microbial cell", as used herein, means a cell from a microorganism.

As used herein, the term "nucleic acid" refers to a polynucleotide, such as deoxyribonucleic acid (DNA), and, where appropriate, ribonucleic acid (RNA). The term also includes analogs of either RNA or DNA made from nucleotide analogs, and, as applicable to the embodiment being described, single (sense or antisense) and double-stranded polynucleotides, ESTs, chromosomes, cDNAs, mRNAs, and rRNAs. The term "nucleic acid" may be used interchangeably with "polynucleotide," "DNA," "nucleic acid molecule," "nucleotide sequence," and/or "gene" unless otherwise indicated herein or otherwise clearly contradicted by context.

As used herein, the term "operably linked" means that a selected nucleotide sequence (e.g., encoding a polypeptide described herein) is in proximity with a promoter to allow the promoter to regulate expression of the selected nucleotide sequence. In addition, the promoter is located upstream of the selected nucleotide sequence in terms of the direction of transcription and translation. By "operably linked" is meant that a nucleotide sequence and a regulatory sequence(s) are connected in such a way as to permit gene expression when the appropriate molecules (e.g., transcriptional activator proteins) are bound to the regulatory sequence(s).

The term "or" is used herein to mean, and is used interchangeably with, the term "and/or," unless context clearly indicates otherwise.

As used herein, "overexpress" means to express or cause to be expressed or produced a nucleic acid, polypeptide, or hydrocarbon in a cell at a greater concentration than is normally expressed in a corresponding wild-type cell. For example, a polypeptide can be "overexpressed" in a recombinant host cell when the polypeptide is present in a greater concentration in the recombinant host cell compared to its concentration in a non-recombinant host cell of the same species.

As used herein, "partition coefficient" or "P," is defined as the equilibrium concentration of a compound in an organic phase divided by the concentration at equilibrium in an aqueous phase (e.g., fermentation broth). In one embodiment of a bi-phasic system described herein, the organic phase is formed by the aldehyde or alkane during the production process. However, in some examples, an organic phase can be provided, such as by providing a layer of octane, to facilitate product separation. When describing a two phase system, the partition characteristics of a compound can be described as log P. For example, a compound with a log P of 1 would partition 10:1 to the organic phase. A compound with a log P of −1 would partition 1:10 to the organic phase. By choosing an appropriate fermentation broth and organic phase, an organic fatty acid derivative or product with a high log P value can separate into the organic phase even at very low concentrations in the fermentation vessel.

As used herein, the term "polypeptide" may be used interchangeably with "protein," "peptide," and/or "enzyme" unless otherwise indicated herein or otherwise clearly contradicted by context.

As used herein, the term "production host" means a cell used to produce the products disclosed herein. The production host is modified to express, overexpress, attenuate or delete expression of selected polynucleotides. Non-limiting examples of production hosts include plant, algal, animal, human, bacteria, yeast, and filamentous fungi cells.

As used herein, the term "purify," "purified," or "purification" means the removal or isolation of a molecule from its environment by, for example, isolation or separation. "Substantially purified" molecules are at least about 60% free, preferably at least about 75% free, and more preferably at least about 90% free from other components with which they are associated. As used herein, these terms also refer to the removal of contaminants from a sample. For example, the removal of contaminants can result in an increase in the percentage of a fatty acid derivative or product in a sample. For example, when a fatty acid derivatives or products are produced in a host cell, the fatty acid derivatives or products can be purified by the removal of host cell proteins. After purification, the percentage of fatty acid derivatives or products in the sample is increased.

The terms "purify," "purified," and "purification" do not require absolute purity. They are relative terms. Thus, for example, when the fatty acid derivatives or products are produced in host cells, a purified fatty acid derivative or product is one that is substantially separated from other cellular components (e.g., nucleic acids, polypeptides, lipids, carbohydrates, or other fatty acid derivatives or products). In another example, a purified fatty acid derivative or purified product preparation is one in which the fatty acid derivative or product is substantially free from contaminants, such as those that might be present following fermentation. In some embodiments, a fatty acid derivative or product is purified when at least about 50% by weight of a sample is composed of the fatty acid derivative or product. In other embodiments, a fatty acid derivative or product is purified when at least about 60%, 70%, 80%, 85%, 90%, 92%, 95%, 98%, or 99% or more by weight of a sample is composed of the fatty acid derivative or product.

As used herein, the term "recombinant polypeptide" refers to a polypeptide that is produced by recombinant DNA techniques, wherein generally DNA encoding the expressed polypeptide or RNA is inserted into a suitable expression vector and that is in turn used to transform a host cell to produce the polypeptide or RNA.

As used herein, the term "substantially identical" (or "substantially homologous") is used to refer to a first amino acid or nucleotide sequence that contains a sufficient number of identical or equivalent (e.g., with a similar side chain) amino acid residues (e.g., conserved amino acid substitutions) or nucleotides to a second amino acid or nucleotide sequence such that the first and second amino acid or nucleotide sequences have similar activities.

As used herein, the term "synthase" means an enzyme which catalyzes a synthesis process. As used herein, the term synthase includes synthases, synthetases, and ligases.

As used herein, the term "transfection" means the introduction of a nucleic acid (e.g., via an expression vector) into a recipient cell by nucleic acid-mediated gene transfer.

As used herein, the term "transformation" refers to a process in which a cell's genotype is changed as a result of the cellular uptake of exogenous nucleic acid. This may result in the transformed cell expressing a recombinant form of a RNA or polypeptide. In the case of antisense expression from the transferred gene, the expression of a naturally-occurring form of the polypeptide is disrupted.

As used herein, the term "transport protein" means a polypeptide that facilitates the movement of one or more compounds in and/or out of a cellular organelle and/or a cell. A number of these proteins, as well as other useful proteins for making the products described herein, have been disclosed in, for example, International Patent Application Nos. PCT/US2007/011923 and PCT/US2008/058788, which are incorporated herein by reference.

As used herein, a "variant" of polypeptide X refers to a polypeptide having the amino acid sequence of polypeptide X in which one or more amino acid residues is altered. The variant may have conservative changes or nonconservative changes. Guidance in determining which amino acid residues may be substituted, inserted, or deleted without affecting biological activity may be found using computer programs well known in the art, for example, LASERGENE software (DNASTAR).

The term "variant," when used in the context of a polynucleotide sequence, may encompass a polynucleotide sequence related to that of a gene or the coding sequence thereof. This definition may also include, for example, "allelic," "splice," "species," or "polymorphic" variants. A splice variant may have significant identity to a reference polynucleotide, but will generally have a greater or fewer number of polynucleotides due to alternative splicing of exons during mRNA processing. The corresponding polypeptide may possess additional functional domains or an absence of domains. Species variants are polynucleotide sequences that vary from one species to another. The resulting polypeptides generally will have significant amino acid identity relative to each other. A polymorphic variant is a variation in the polynucleotide sequence of a particular gene between individuals of a given species.

As used herein, the term "vector" refers to a nucleic acid molecule capable of transporting another nucleic acid to which it has been linked. One type of useful vector is an episome (i.e., a nucleic acid capable of extra-chromosomal replication). Useful vectors are those capable of autonomous replication and/or expression of nucleic acids to which they are linked. Vectors capable of directing the expression of genes to which they are operatively linked are referred to herein as "expression vectors". In general, expression vectors of utility in recombinant DNA techniques are often in the form of "plasmids," which refer generally to circular double stranded DNA loops that, in their vector form, are not bound to the chromosome. In the present specification, "plasmid" and "vector" are used interchangeably, as the plasmid is the most commonly used form of vector. However, also included are such other forms of expression vectors that serve equivalent functions and that become known in the art subsequently hereto.

As used herein, the term "wax" means a composition comprised of fatty esters. In a preferred embodiment, the fatty ester in the wax is comprised of medium to long carbon chains. In addition to fatty esters, a wax may comprise other components (e.g., hydrocarbons, sterol esters, aliphatic aldehydes, alcohols, ketones, beta-diketones, triacylglycerols, etc.).

Throughout the specification, a reference may be made using an abbreviated gene name or polypeptide name, but it is understood that such an abbreviated gene or polypeptide name represents the genus of genes or polypeptides. Such gene names include all genes encoding the same polypeptide and homologous polypeptides having the same physiological function. Polypeptide names include all polypeptides that have the same activity (e.g., that catalyze the same fundamental chemical reaction).

The accession numbers referenced herein are derived from the NCBI database (National Center for Biotechnology Information) maintained by the National Institute of Health, U.S.A. Unless otherwise indicated, the accession numbers are as provided in the database as of April 2009.

EC numbers are established by the Nomenclature Committee of the International Union of Biochemistry and Molecular Biology (NC-IUBMB) (available at http://www.chem.qmul.ac.uk/iubmb/enzyme/). The EC numbers referenced herein are derived from the KEGG Ligand database, maintained by the Kyoto Encyclopedia of Genes and Genomics, sponsored in part by the University of Tokyo. Unless otherwise indicated, the EC numbers are as provided in the database as of April 2009.

Unless otherwise defined, all technical and scientific terms used herein have the same meaning as commonly understood by one of ordinary skill in the art to which this invention belongs.

Although methods and materials similar or equivalent to those described herein can be used in the practice or testing of the present invention, suitable methods and materials are described below. All methods described herein can be performed in any suitable order unless otherwise indicated herein or otherwise clearly contradicted by context.

Unless otherwise stated, amounts listed in percentage (%) are in weight percent, based on the total weight of the composition.

All publications, patent applications, patents, and other references mentioned herein are incorporated by reference in their entirety. In case of conflict, the present specification, including definitions, will control. In addition, the materials, methods, and examples are illustrative only and not intended to be limiting.

Recitation of ranges of values herein are merely intended to serve as a shorthand method of referring individually to each separate value falling within the range, unless otherwise indicated herein, and each separate value is incorporated into the specification as if it were individually recited herein.

The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

Other features and advantages of the invention will be apparent from the following detailed description and from the claims.

The invention is based, at least in part, on the discovery that fatty acids and/or fatty acid derivatives such as fatty esters can be produced by culturing genetically engineered host cells comprising an expressed or overexpressed ester synthase or a suitable variant thereof, but an attenuated level or in an absence of either or both a fatty acid degradation enzyme such as an acyl-CoA synthase a thioesterase, as compared to the naturally-occurring level of such enzymes. Compared to the previously disclosed methods of producing fatty acids and/or fatty acid derivatives through microbial fermentation procedures, which typically involve, in addition to an ester synthase, at least one of a thioesterase and a fatty acid degradation enzyme such as an acyl-CoA synthase, which preferably require the presence of increased activities or levels of these enzymes, the instant method is more energetically favorable and efficient. For example, the method described herein allows the direct conversion of a thioester, such as an acyl-ACP and/or an acyl-CoA, to a fatty acid and/or a fatty acid derivative, bypassing the requirement to first hydrolyze an ACP to make a fatty acid and then reactivate the fatty acid to produce an acyl-CoA.

Ester Synthase Genes and Variants

Fatty esters can be produced by culturing genetically engineered host cells comprising ester synthase enzymes, nucleic acids encoding these enzymes, vectors comprising nucleic acids encoding these enzymes, or by culturing recombinant host cells transformed with the vectors, and recombinant host cells comprising polynucleotides encoding these ester synthase enzymes, which are chromosomally integrated therein. Specifically, the method includes expressing in a host cell a gene encoding an ester synthase, selected from, for example, the enzymes classified as EC 2.3.1.75, which catalyzes the enzymatic transfer of saturated or unsaturated acyl residues, for example, those of chain-length $C_{18}$ to $C_{20}$, to alcohols. The ester synthase may be one selected from the group consisting of a wax-ester synthase, an acyl-CoA:alcohol transacylase, an acyltransferase, and a fatty acyl-CoA:fatty alcohol acyltransferase. For example, the ester synthase gene can be one that encodes ws/dgat, a bifunctional ester synthase/acyl-CoA/acyl-CoA: diacylglycerol acyltransferase from *Simmondsia chinensis, Acinetobacter* sp., *Acinetobacter* sp. ADPJ, *alcanivorax borkumensis, Pseudomonas aeruginosa, Fundibacter jadensis, Arabidopsis thaliana*, or *Alkaligenes eutrophus*. In some embodiments, the invention features a method of making a fatty acid or a fatty acid derivative such as, for example, a fatty ester, wherein the method includes expressing in a host cell a gene encoding an ester synthase selected from the group consisting of AtfA1 (YP_694462, SEQ ID NO:25), AtfA2 (YP_693524, SEQ ID NO:26), ES9 (ABO21021, SEQ ID NO:18), and ES8 (ABO21020, SEQ ID NO:24), or a variant thereof.

In certain embodiments, the invention features a method of making a fatty acid or a fatty acid derivative such as, for example a fatty ester, wherein the method includes expressing in a host cell a gene encoding an ester synthase polypeptide comprising the amino acid sequence of SEQ ID NO: 18, 24, 25, or 26, or a variant thereof. In certain embodiments, the polypeptide or variant has ester synthase and/or acyltransferase activity. In particular embodiments, the polypeptide or variant catalyzes the conversion of a thioester into a fatty acid and/or a fatty acid derivative, using an alcohol as substrate. In one example, the polypeptide or variant catalyzes the conversion of an acyl-CoA to a fatty acid and/or a fatty acid derivative, using an alcohol as substrate. In another example, the polypeptide or variant catalyzes the conversion of an acyl-ACP to a fatty acid and/or a fatty acid derivative, using an alcohol as substrate. In yet another example, the polypeptide or variant also converts a free fatty acid to a fatty ester using an alcohol as substrate. The alcohol substrates can be short- or long-chain alcohols. In some embodiments, the alcohol substrate is a methanol, and accordingly, the host cell expressing the ester synthase or variant produces a fatty acid and/or a fatty acid methyl derivative, such as a methyl ester. In other embodiments, the alcohol substrate is an ethanol, and accordingly, the host cell expressing the ester synthase or variant produces a fatty acid and/or a fatty acid ethyl derivative, such as an ethyl ester.

In certain embodiments, an endogenous thioesterase of the host cell, if present, is unmodified. In other embodiments, the host cell expresses an attenuated level of a thioesterase, as compared to the naturally-occurring level of that thioesterase. In alternative embodiments, a thioesterase is functionally deleted. In some embodiments, there is no dectable thioesterase activity in the host cell. In other embodiments, the host cell expresses an attenuated level of a fatty acid degradation enzyme, such as an acyl-CoA synthase, as compared to the naturally-occurring level of that enzyme. In alternative embodiment, an acyl-CoA synthase is functionally deleted. In some embodiments, the host cell has no detectable acyl-CoA synthase activity. In further embodiments, the host cell expresses attenuated levels of a thioesterase and a fatty acid degradation enzyme such as an acyl-CoA synthase. In yet further embodiments, a thioesterase and an acyl-CoA synthase are functionally deleted. In some embodiments, the host cell has no detectable activity of a thioesterase or an acyl-CoA synthase.

In certain embodiments, the method comprises expressing in a host cell a gene encoding an ester synthase polypeptide comprising the amino acid sequence of SEQ ID NO:18, 24, 25, or 26, or a variant thereof, wherein a thioesterase, an acyl-CoA synthase, or both, are functionally deleted or knocked out from the host cell. In some embodiments, the host cell has no detectable thioesterase activity or acyl-CoA synthase activity.

Variant can be naturally occurring or created in vitro. In particular, variants can be created using genetic engineering techniques, such as site directed mutagenesis, random chemical mutagenesis, exonuclease III deletion procedures, or standard cloning techniques. Alternatively, such variants, fragments, analogs, or derivatives can be created using chemical synthesis or modification procedures.

Methods of making variants are well known in the art. These include procedures in which nucleic acid sequences obtained from natural isolates are modified to generate nucleic acids that encode polypeptides having characteristics that enhance their value in industrial or laboratory applications. In such procedures, a large number of variant sequences having one or more nucleotide differences with respect to the sequence obtained from the natural isolate are generated and characterized. Typically, these nucleotide difference result in amino acid changes with respect to the polypeptides encoded by the nucleic acids from the natural isolates.

For example, variants can be created using error prone PCR (see, e.g., Leung et al., *Technique* 1:11-15 (1989); and Caldwell et al., *PCR Methods Applic.* 2:28-33 (1992)). In error prone PCR, PCR is performed under conditions where the copying fidelity of the DNA polymerase is low, such that a high rate of point mutations is obtained along the entire length of the PCR product. Briefly, in such procedures, nucleic acids to be mutagenized (e.g., an ester synthase sequence), are mixed with PCR primers, reaction buffer, $MgCl_2$, $MnCl_2$, Taq polymerase, and an appropriate concentration of dNTPs for achieving a high rate of point mutation along the entire length of the PCR product. For example, the reaction can be performed using 20 fmoles of nucleic acid to be mutagenized (e.g., an ester synthase polynucleotide sequence), 30 pmole of each PCR primer, a reaction buffer comprising 50 mM KCl, 10 mM Tris HCl (pH 8.3), and 0.01% gelatin, 7 mM $MgCl_2$, 0.5 mM $MnCl_2$, 5 units of Taq polymerase, 0.2 mM dGTP, 0.2 mM dATP, 1 mM dCTP, and 1 mM dTTP. PCR can be performed for 30 cycles of 94° C. for 1 min, 45° C. for 1 min, and 72° C. for 1 min. However, it will be appreciated that these parameters can be varied as appropriate. The mutagenized nucleic acids are then cloned into an appropriate vector and the activities of the polypeptides encoded by the mutagenized nucleic acids are evaluated.

Variants can also be created using oligonucleotide directed mutagenesis to generate site-specific mutations in any cloned DNA of interest. Oligonucleotide mutagenesis is described in, for example, Reidhaar-Olson et al., *Science* 241:53-57 (1988). Briefly, in such procedures a plurality of double stranded oligonucleotides bearing one or more mutations to be introduced into the cloned DNA are synthesized and inserted into the cloned DNA to be mutagenized (e.g., an ester synthase polynucleotide sequence). Clones containing the mutagenized DNA are recovered, and the activities of the polypeptides they encode are assessed.

Another method for generating variants is assembly PCR. Assembly PCR involves the assembly of a PCR product from a mixture of small DNA fragments. A large number of different PCR reactions occur in parallel in the same vial, with the products of one reaction priming the products of another reaction. Assembly PCR is described in, for example, U.S. Pat. No. 5,965,408.

Still another method of generating variants is sexual PCR mutagenesis. In sexual PCR mutagenesis, forced homologous recombination occurs between DNA molecules of different, but highly related, DNA sequence in vitro as a result of random fragmentation of the DNA molecule based on sequence homology. This is followed by fixation of the crossover by primer extension in a PCR reaction. Sexual PCR mutagenesis is described in, for example, Stemmer, *PNAS, USA* 91:10747-10751 (1994).

Variants can also be created by in vivo mutagenesis. In some embodiments, random mutations in a nucleic acid sequence are generated by propagating the sequence in a bacterial strain, such as an *E. coli* strain, which carries mutations in one or more of the DNA repair pathways. Such "mutator" strains have a higher random mutation rate than that of a wild-type strain. Propagating a DNA sequence (e.g., an ester synthase polynucleotide sequence) in one of these strains will eventually generate random mutations within the DNA. Mutator strains suitable for use for in vivo mutagenesis are described in, for example, PCT Publication No. WO 91/16427.

Variants can also be generated using cassette mutagenesis. In cassette mutagenesis, a small region of a double stranded DNA molecule is replaced with a synthetic oligonucleotide "cassette" that differs from the native sequence. The oligonucleotide often contains a completely and/or partially randomized native sequence.

Recursive ensemble mutagenesis can also be used to generate variants. Recursive ensemble mutagenesis is an algorithm for protein engineering (i.e., protein mutagenesis) developed to produce diverse populations of phenotypically related mutants whose members differ in amino acid sequence. This method uses a feedback mechanism to control successive rounds of combinatorial cassette mutagenesis. Recursive ensemble mutagenesis is described in, for example, Arkin et al., *PNAS, USA* 89:7811-7815 (1992).

In some embodiments, variants are created using exponential ensemble mutagenesis. Exponential ensemble mutagenesis is a process for generating combinatorial libraries with a high percentage of unique and functional mutants, wherein small groups of residues are randomized in parallel to identify, at each altered position, amino acids which lead to functional proteins. Exponential ensemble mutagenesis is described in, for example, Delegrave et al., *Biotech. Res.* 11:1548-1552 (1993). Random and site-directed mutageneses are described in, for example, Arnold, *Curr. Opin. Biotech.* 4:450-455 (1993).

In some embodiments, variants are created using shuffling procedures wherein portions of a plurality of nucleic acids that encode distinct polypeptides are fused together to create chimeric nucleic acid sequences that encode chimeric polypeptides as described in, for example, U.S. Pat. Nos. 5,965,408 and 5,939,250.

Polynucleotide variants also include nucleic acid analogs. Nucleic acid analogs can be modified at the base moiety, sugar moiety, or phosphate backbone to improve, for example, stability, hybridization, or solubility of the nucleic acid. Modifications at the base moiety include deoxyuridine for deoxythymidine and 5-methyl-2'-deoxycytidine or 5-bromo-2'-doxycytidine for deoxycytidine. Modifications of the sugar moiety include modification of the 2' hydroxyl of the ribose sugar to form 2'-O-methyl, 2'-halo, or 2'-O-allyl sugars. The deoxyribose phosphate backbone can be modified to produce morpholino nucleic acids, in which each base moiety is linked to a six-membered, morpholino ring, or peptide nucleic acids, in which the deoxyphosphate backbone is replaced by a pseudopeptide backbone and the four bases are retained. (See, e.g., Summerton et al., *Antisense Nucleic Acid Drug Dev.* 7:187-195 (1997); and Hyrup et al., *Bioorgan. Med. Chem.* 4:5-23 (1996).) In addition, the deoxyphosphate backbone can be replaced with, for example, a phosphorothioate or phosphorodithioate backbone, a phosphoroamidite, or an alkyl phosphotriester backbone.

In some embodiments, the ester synthase polypeptide is a variant comprising the amino acid sequence of SEQ ID NO:18, 24, 25, or 26, with one or more amino acid substitutions, additions, insertions, or deletions, and the polypeptide has ester synthase and/or acyltransferase activity. For example, the ester synthase variant catalyzes the conversion of thioesters to fatty acids and/or fatty acid derivatives, using alcohols as substrates. In certain embodiments, the ester synthase variant also catalyzes the conversion of free fatty acids to fatty esters.

In some instances, the methods described herein can be used to produce fatty acids or fatty acid derivatives using an ester synthase polypeptide having an amino acid sequence of SEQ ID NO:18, 24, 25, or 26, as well as a polypeptide variants thereof. Ester synthase polypeptide variant can be variants in which one or more amino acid residues are substituted with conserved or non-conserved amino acid residues. Such substituted amino acid residues may or may not be ones encoded by the genetic code.

In some embodiments, the ester synthase polypeptide is a variant comprising the amino acid sequence of SEQ ID NO:18, 24, 25, or 26, with one or more non-conserved amino acid substitutions, wherein the polypeptide variant has ester synthase and/or acyltransferase activity. In some embodiments, the glycine residue at position 395 of SEQ ID NO:18 is substituted with a basic amino acid residue, wherein the resultant ester synthase variant retains or has improved ester synthase and/or acyltransferase activity.

In some embodiments, the ester synthase polypeptide is a variant comprising the amino acid sequence of SEQ ID NO:18, 24, 25, or 26, with one or more conserved amino acid substitutions. Conserved substitutions are those that substitute a given amino acid residue in a polypeptide by another amino acid of similar characteristics. Typical conserved substitutions include the following replacements: replacement of an aliphatic amino acid, such as alanine, valine, leucine, and isoleucine, with another aliphatic amino acid; replacement of a serine with a threonine; replacement of a threonine with a serine; replacement of an acidic residue, such as aspartic acid and glutamic acid, with another acidic residue; replacement of residue bearing an amide group; exchange of a basic residue, such as lysine and arginine, with another basic residue; and replacement of an aromatic residue, such as phenylalanine and tyrosine, with another aromatic residue. In some embodiment, the ester synthase polypeptide variant has ester synthase and/or acyltransferase activity. For example, the ester synthase polypeptide variant catalyzes the conversion of a thioester into a fatty acid and/or a fatty acid derivative. In another example, the ester synthase polypeptide catalyzes the conversion of a free fatty acid into a fatty ester.

Other polypeptide variants include those in which one or more amino acid residues include a substituent group. Still other polypeptide variants include those in which the polypeptide is associated with another compound, such as a compound to increase the half-life of the polypeptide (e.g., polyethylene glycol).

Additional polypeptide variants are those in which additional amino acid residues are fused to the polypeptide, such as a leader sequence, a secretory sequence, a proprotein sequence, or a sequence which facilitates purification, enrichment, or stabilization of the polypeptide.

In certain instances, the polypeptide variants retain the same biological function as a polypeptide having an amino acid sequence of, for example, SEQ ID NO:18, 24, 25, or 26 and have amino acid sequences substantially identical thereto. In particular instances, the polypeptide variants retains the ester synthase and/or acyltransferase activity of, for example, a polypeptide of the amino acid sequence SEQ ID NO:18.

In other instances, the polypeptide variants has at least about 35%, at last about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% homology to an amino acid sequence of SEQ ID NO:18, 24, 25, or 26. In another instance, the polypeptide variants include a fragment comprising at least about 5, 10, 15, 20, 25, 30, 35, 40, 45, 50, 60, 70, 80, 90, 100, 150, 200 consecutive amino acid residues thereof.

The polypeptide variants or fragments thereof can be obtained by isolating nucleic acids encoding them using techniques described herein or by expressing synthetic nucleic acids encoding them. Alternatively, polypeptide variants or fragments thereof can be obtained through biochemical enrichment or purification procedures. The sequence of polypeptide variants or fragments can be determined by proteolytic digestion, gel electrophoresis, and/or microsequencing. For example, the sequence of the polypeptide variants or fragments can then be compared to an amino acid sequence of SEQ ID NO:18, 24, 25, or 26 using any of the programs described herein.

The polypeptide variants and fragments thereof can be assayed for ester synthase activity and/or acyltransferase activity using routine methods. For example, the polypeptide variants or fragments can be contacted with a substrate (e.g., an acyl-CoA, an acyl-ACP, a free fatty acid, or an alcohol) under conditions that allow the polypeptide to function. A decrease in the level of the substrate or an increase in the level of a fatty acid and/or a fatty acid derivative product can be measured to determine the ester synthase/acyltransferase activity.

In some embodiments, the ester synthase polypeptide variant can comprise the amino acid sequence of SEQ ID NO:18, 24, 25, or 26, with one or more non-conserved amino acid substitutions but continues to have ester synthase and/or acyltransferase activity. In some embodiments, the glycine residue at position 395 is substituted with a basic amino acid residue, wherein the resultant ester synthase variant retains or has improved ester synthase and/or acyltransferase activity, relative to that of a native or wild-type ester synthase. In a particular instance, the glycine residue at position 395 of SEQ ID NO:18 is substituted with an arginine or a lysine, wherein the resultant ester synthase variant has improved ester synthase and/or acyltransferase activity, relative to the activity of the wild type ester synthase of SEQ ID NO:18.

In some embodiments, the polypeptide comprises one or more conserved amino acid substitutions. In some embodiments, the polypeptide has about 1, 2, 3, 4, 5, 6, 7, 8, 9, 10, 15, 20, 30, 40, 50, 60, 70, 80, 90, 100, or more amino acid substitutions, additions, insertions, or deletions. In some embodiments, the polypeptide comprising the one or more amino acid substitutions, additions, insertions or deletions retains the same biological activity as a polypeptide of SEQ ID NO:18, 24, 25, or 26. As used herein, "retaining a biological activity" refers to the retention of a detectable level of that biological activity, rather than the retention of the same level of an activity. For example, the polypeptide comprising one or more amino acid substitutions, additions, insertions or deletions has ester synthase and/or acyltransferase activity. For example, the polypeptide is capable of catalyzing the conversion of thioesters to fatty acids and/or fatty acid derivatives such as fatty esters, using alcohols as substrates. Suitably thioester substrates include, for example, fatty thioesters such as fatty acyl-CoAs or fatty acyl-ACPs. In another example, the polypeptide is capable of catalyzing the conversion of a free fatty acid into a fatty ester using an alcohol as substrate. Suitable alcohol substrates include, for example, long- or short-chain alcohols such as methanol, ethanol, propanol, butanol, pentanol, hexanol, heptanol, octanol, decanol, dodecanol, tetradecanol, or hexadecanol.

In certain embodiments, the invention pertains to methods of producing a fatty acid or a fatty acid derivative such as, for example, a fatty ester, wherein the method includes expressing in a host cell a gene or polynucleotide encoding a variant of ester synthase, ES9 (GenBank Accession No. ABO21021, SEQ ID NO:18), wherein the host cell expresses an attenuated level of a thioesterase, or wherein the thioesterase is functionally deleted. In other embodiments, the invention pertains to methods of producing a fatty acid or a fatty acid derivative such as, for example, a fatty ester, wherein the method includes expressing in a host cell a gene encoding a variant of ES9 (SEQ ID NO:18), wherein the host cell expresses an attenuated level of a fatty acid degradation enzyme such as an acyl-CoA synthase, or wherein the acyl-CoA synthase is functionally deleted. In a further embodiment, the invention pertains to methods of producing a fatty acid or a derivative thereof, wherein the method includes expressing in a host cell a gene encoding a variant of ES9 (SEQ ID NO:18), wherein the host cell express attenuated levels of a thioesterase, a fatty acid degradation enzyme such as an acyl-CoA synthase, or both, or wherein the thioesterase, the acyl-CoA synthase, or both, are functionally deleted. In some embodiments, the host cell has no detectable thioesterase activity or acyl-CoA synthase activity.

In some embodiments, the variant of ester synthase comprises a substitution at the amino acid residue corresponding to position 395 of SEQ ID NO:18. In a particular embodiment, the variant comprises a basic amino acid residue at position 395, replacing the glycine residue at that position of SEQ ID NO:18. For example, the basic amino acid residue can be a lysine or an arginine residue. In some embodiments, the variant has the same or improved ester synthase and/or acyltransferase activity, relative to that of the polypeptide of SEQ ID NO:18.

In certain embodiments, the invention pertains to methods of producing a fatty acid or a fatty acid derivative wherein the method includes expressing in a host cell a polynucleotide encoding a variant of ester synthase ES9, wherein the host cell further expresses an attenuated level of thioesterase, an acyl-CoA synthase, or both, or wherein the thioesterase, the acyl-CoA synthase, or both, are functionally deleted. In some embodiments, the variant of ester synthase comprises a substitution at the amino acid residue corresponding to position 395 of SEQ ID NO:18 and one or more other amino acid substitutions, additions, insertions or deletions, and the variant has ester synthase and/or acyltransferase activity. In some embodiments, the variant catalyzes the conversion of thioester substrates and/or alcohol substrate into fatty acids and/or fatty acid derivatives. In other embodiments, the variant catalyzes the conversion of free fatty acids into fatty esters.

In some embodiments, the ester synthase polypeptide or a variant thereof is about 200 amino acids to about 2,000 amino acids in length, for example, from about 250 to about 1500 amino acid residues in length, from about 300 to about 1200 amino acid residues in length, from about 350 to about 1000 amino acid residues in length, from about 400 to about 800 amino acid residues in length, or from about 450 to about 600 amino acid residues in length. In certain embodiments, the naturally-occurring ester synthase polypeptide is about 300 amino acid residues in length or longer, for example, about 400 amino acid residues in length or longer, or about 450 amino acid residues in length or longer. In certain related embodiments, the ester synthase polypeptide or the variant thereof is about 1000 amino acid residues in length or shorter, for example, about 800 amino acid residues in length or shorter, about 700 amino acid residues in length or shorter, or about 600 amino acid residues in length or shorter. An exemplary ester synthase of the invention is about 500 amino acid residues in length.

Additional ester synthases that can be used are described in the PCT patent application entitled "Production of Fatty Acid Derivatives", filed concurrently herewith, under Appln. PCT/US10/50026.

Antibodies to Ester Synthase Polypeptides

The ester synthase polypeptides described herein can be used to produce antibodies directed against ester synthase polypeptides. Such antibodies can be used, for example, to detect expression of an ester synthase polypeptide using methods known in the art. The antibody can be, for example, a polyclonal antibody; a monoclonal antibody or antigen binding fragment thereof; a modified antibody such as a chimeric antibody, reshaped antibody, humanized antibody, or fragment thereof (e.g., Fab', Fab, F(ab')2); or a biosynthetic antibody, for example, a single chain antibody, single domain antibody (DAB), Fv, single chain Fv(scFv), or the like.

Methods of making and using polyclonal and monoclonal antibodies are described, for example, in Harlow et al., Using Antibodies: A Laboratory Manual: Portable Protocol I. Cold Spring Harbor Laboratory (Dec. 1, 1998). Methods for making modified antibodies and antibody fragments (e.g., chimeric antibodies, reshaped antibodies, humanized antibodies, or fragments thereof, e.g., Fab', Fab, F(ab')2 fragments); or biosynthetic antibodies (e.g., single chain antibodies, single domain antibodies (DABs), Fv, single chain Fv (scFv), and the like), are known in the art and can be found, for example, in Zola, Monoclonal Antibodies: Preparation and Use of Monoclonal Antibodies and Engineered Antibody Derivatives, Springer Verlag (Dec. 15, 2000; 1$^{st}$ edition).

Substrates

The compositions and methods described herein can be used to product fatty acids and/or fatty acid derivatives, for example, from thioesters and alcohols, or from free fatty acids and alcohols, which themselves can be produced from appropriate substrates in the same host cell. While not wishing to be bound by theory, it is believed that the recombinantly modified production host can be modified to increase the production of thioester substrates such as, for example, acyl-CoAs or acyl-ACPs, of free fatty acids, or of suitable alcohol substrates such as, for example, fatty alcohols. Moreover, the recombinantly modified production host can be modified to reduce the catabolism of fatty acids or fatty acid derivatives and/or intermediates in the fatty acid biosynthetic pathways, or to reduce feedback inhibition at specific points in the same pathway. In addition to modifying the genes described herein, additional cellular resources can be diverted to over-produce fatty acids and/or fatty acid derivatives. For example, the lactate, succinate, and/or acetate pathways can be attenuated, and acetyl-CoA carboxylases (encoded by acc genes) can be overexpressed. Modifications to production host can be achieved, for example, through genomic alterations, addition of recombinant expression systems, or combinations thereof.

A representative fatty acid and/or fatty acid derivative biosynthetic pathway is depicted in FIG. 1A. The following sections describe the steps in these pathways. Different steps in the pathway are catalyzed by a variety of enzymes. Each step within a pathway that leads to the production of a fatty acid and/or a fatty acid derivative substrate can be modified to produce or overproduce the substrate of interest. For example, known genes involved in the fatty acid biosynthetic pathway can be expressed, overexpressed, or attenuated in host cell to produce the desired substrate (see, e.g., the approach described in PCT/US08/05877, the disclosure of which is incorporated herein by reference). Exemplary genes that may serve as the points of change include, without limitation, accA (EC 6.4.1.2), accB (EC 6.4.1.2), accC (EC 6.4.1.2, EC 6.3.4.14), accD (EC 6.4.1.2), aceE (EC 1.2.4.1), aceF (EC 2.3.1.12), fabD (EC 2.3.1.39), fabG (EC 1.1.1.100), fabH (EC 2.3.1.180), panD (EC 4.1.1.11), panK (EC 2.7.1.33), pdh (EC 1.2.4.1), udhA (EC 1.6.1.1).

Fatty acid synthase (FAS) is a group of peptides that catalyze the initiation and elongation of acyl chains (Marrakchi et al., *Biochemical Society*, 30:1050-1055 (2002)). The acyl carrier protein (ACP) along with the enzymes in the FAS pathway controls the length, degree of saturation, and branching of the fatty acids produced. The steps in this pathway are catalyzed by enzymes of the fatty acid biosynthesis (fab) and acetyl-CoA carboxylase (acc) gene families. (see, e.g., Heath et al., *Prog. Lipid Res.* 40(6):467-97 (2001)). Depending on the desired product, one or more of these genes can be attenuated or overexpresssed.

Host cells can be engineered to express fatty acid derivative substrates by recombinantly expressing or overexpressing one or more fatty acid synthase genes, such as acetyl-CoA and/or malonyl-CoA synthase genes. For example, to increase acetyl-CoA production one or more of the following genes can be expressed or overexpressed in a host cell: pdh, panK, aceEF (encoding the E1p dehydrogenase component and the E2p dihydrolipoamide acyltransferase component of the pyruvate and 2'-oxoglutarate dehydrogenase complexes), fabH, fabD, fabG, acpP, and fabF. Exemplary GenBank Accession numbers for these genes are listed in the parentheses after the gene names: pdh (BAB34380, AAC73227, AAC73226), panK (also known as coaA, AAC96952), aceEF (AAC73227, AAC73226), fabH (AAC74175), fabD (AAC74176), fabG (AAC74177), acpP (AAC74178), fabF (AAC74179).

Additionally, the expression levels of fadE, gpsA, ldhA, pflb, adhE, pta, poxB, ackA, and/or ackB can be reduced or functionally deleted in the engineered microorganism by transformation with conditionally replicative or non-replicative plasmids containing null or deletion mutations of the corresponding genes, or by substituting promoter or enhancer sequences. Exemplary GenBank Accession numbers for these genes are listed in the parentheses: fadE (AAC73325), gspA (AAC76632), ldhA (AAC74462), pflb (AAC73989), adhE (AAC74323), pta (AAC75357), poxB (AAC73958), ackA (AAC75356), and ackB (BAB81430). In an exemplary embodiment, fadE expression is attenuated or functionally deleted in a production host cell of the present invention. The resulting engineered production hosts can produce increased levels of acetyl-CoA when cultivated in an appropriate environment.

Similarly, malonyl-CoA overproduction can be effectuated by engineering the production host as described with accABCD (e.g., GenBank Accession No. AAC73296, classified as EC 6.4.1.2) included in the plasmid synthesized de novo. Fatty acid overproduction can be achieved by further including a DNA sequence encoding lipases (e.g., GenBank Accession Nos: CAA89087, CAA98876), in the plasmid synthesized de novo.

The resultant host cells, in some embodiments, overexpresses acetyl-CoA such that its intracellular concentration is increased by more than about 2-fold, for example, by more than about 5-fold, or more than about 10 fold, relative to the native expression levels of acetyl-CoA.

Acetyl-CoA and malonyl-CoA overproduction can be verified using methods known in the art, for example, by using radioactive precursors, HPLC, and GC-MS following cell lysis.

Additionally, the PlsB (e.g., GenBank Accession No. AAC77011) D311E mutant can be used to increase the amount of acyl-CoA available.

Furthermore, overexpression of an sfa gene (suppressor of FabA, e.g., GenBank Accession No. AAN79592) can be effectuated in a production host to increase the production of monounsaturated fatty acids (Rock et al., *J. Bacteriology* 178:5382-5387 (1996)).

In a typical microbial process model for fatty acid and fatty acid derivative synthesis, acetyl-CoA and malonyl-CoA are converted through a series of steps to form the acyl-ACP chains. Acyl-ACP is then converted via a series of alternative enzymatic steps into various end products, including fatty acid derivatives. For example, typically acyl-ACP is converted to fatty esters by the combined consecutive reactions of a thioesterase, an acyl-CoA ligase/synthetase and an ester synthase. A limitation to the commercial use of these enzymes in a metabolic pathway is the requirement of hydrolysis of ACP to produce fatty acids that are subsequently reactivated to produce the fatty acyl-CoA substrates, which requires at least two enzymatic steps and the expenditure of metabolic energy from two phosphoanhydride bonds. It has been discovered that fatty acids and/or fatty acid derivatives such as, for example, fatty esters, can be produced in the presence of an ester synthase, bypassing the participations of a thioesterase, and/or bypassing the participation of a fatty acid degradation enzyme such as an acyl-CoA synthase. This more economical and efficient approach mitigates the loss of ATP caused by an otherwise multi-step pathway. Specifically, it has been discovered that a suitable ester synthase, in the absence of a co-expressed thioesterase, and/or a co-expressed fatty acid degradation enzyme such as an acyl-CoA synthase, can effectively utilize thioesters such as acyl-ACPs or acyl-CoAs, free fatty acids, and/or alcohols such as short- or long-chain alcohols, as substrates to produce desirable fatty acids and/or fatty acid derivatives under appropriate conditions.

One of ordinary skill in the art is capable of determining the fitness of using a particular ester synthase enzyme to directly produce fatty acids and/or fatty acid derivatives from thioester substrates. Example 14 describes representative assays that can be used, among other suitable methods, to determine whether a fatty acid and/or fatty acid derivatives is produced and/or the amount that is produced in a given production system.

According to this aspect of the invention, then, various ester synthases can be utilized to directly produce fatty acids and/or fatty acid derivatives, in the presence or in the absence of a thioesterase, and/or in the presence or in the absence of a fatty acid degradation enzyme such as, for example, an acyl-CoA synthase. For example, expression or overexpression of an ester synthase that can catalyze the direct production of fatty acids and/or fatty acid derivatives in a recombinant host strain. This can be used to supplement fatty acid derivative production where the strain also expresses a thioesterase and/or a fatty acid degradation enzyme. For example, on occasions wherein free fatty acids are undesirable products of a fatty ester production process, the free fatty acids can be converted into fatty esters using the ester synthases, variants, host cells, and microorganisms and methods herein. Additionally, expression of an ester synthase that can catalyze the direct production of fatty acids and/or fatty acid derivatives such as fatty esters in a recombinant host cell can be used where there is no or low thioesterase expression.

The term "thioesterase" refers to an enzyme that has thioesterase activity. Thioesterases include thioester hydrolases, which are identified as members of Enzyme Classification E.C. 3.1.2 and are obtainable from a variety of sources. Plant thioesterases are described in, for example, Voelker & Davies, *J. Bact.*, 176 (23): 7320-27 (1994), U.S. Pat. Nos. 5,667,997 and 5,455,167. Thioesterases are also obtainable from microbial sources, such as those described in Akoh et al., *Prog. Lipid Res.*, 43(6):534-52 (2004); Diczfalusy & Alexson, *Arch. Biochem. Biophys.*, 334(1):104-12 (1996); Larson & Kolattukudy, *Arch. Biochem. Biophys.*, 237(1):27-37 (1985); Lawson et al., *Biochemistry* 33(32):9382-88 (1994); Lee et al., *Eur. J. Biochem.*, 184 (1):21-28 (1989); Naggert et al., *J. Biol. Chem.*, 266(17):11044-50 (1991); Nie et al., *Biochemistry*, 47 (29):7744-51 (2008); Seay & Lueking, *Biochemistry* 25(9): 2480-85 (1986); Spencer et al., *J. Biol. Chem.*, 253(17):5922-26 (1978); and Zhuang et al., *Biochemistry* 47(9):2789-96 (2008). Thioesterases are also obtainable from, for example, cyanobacterial, algal, mammalian, insect, and fungal sources. A thioesterase can have activity other than thioesterase activity, for example proteolytic activity or oxygen ester hydrolysis activity. A particularly useful thioesterase is the 'TesA (also termed "thioesterase I" or "leaderless thioesterase") enzyme from *E. coli*, which is a truncated version of the full-length TesA serine thioesterase enzyme that is described in Cho & Cronan, *J. Biol. Chem.*, 268(13): 9238-45 (1992). An *E. coli* 'TesA polypeptide comprises 182 amino acids, and is the product of a cleavage reaction wherein the 26 amino acid leader sequence of *E. coli* TesA is removed.

The term "thioesterase activity" refers to the capacity to catalyze a thioester cleavage reaction, which usually involves the hydrolysis of a thioester at a thiol group into an acid and a thiol, but can also include a transesterification step in which a thioester bond is cleaved and a new ester bond is formed. In general, an acyl-ACP thioesterase is capable of catalyzing the hydrolytic cleavage of fatty acyl-acyl carrier protein thioesters and/or fatty acyl-CoA thioesters. Examples of enzymes having thioesterase activity include acetyl-CoA hydrolase, palmitoyl-CoA hydrolase, succinyl-CoA hydrolase, formyl-CoA hydrolase, acyl-CoA hydrolase, palmitoyl-protein thioesterase, and ubiquitin thiolesterase. Thioesterase activity can be established by any of the following assays:

Acyl-CoA Hydrolysis Assay:

A Tris-HCl buffer, 0.1 M, pH 8.0; Palmitoyl-CoA, 5 µM; DTNB, 0.01 M in 0.1 M potassium phosphate buffer, pH 7.0 are used to prepare a complete assay mixture. The assay mixture thus contains a final concentration of 10 mmol of Tris-HCl buffer, pH 8.0, 0.05 mmol of DTNB, and 0.01 mmol of palmitoyl-CoA. The complete assay mixture is then mixed with the thioesterase, in a final volume of 2.0 mL. The rate of cleavage of the acyl-CoA substrate is measured by monitoring the change in absorbance at 412 nm, using a molar extinction coefficient of 13,600 $M^{-1}cm^{-1}$.

In Vivo Assay:

Following expression of the protein of interest, the culture, which potentially has thioesterase activity, is acidified with 1 N HCl to a final pH of about 2.5 and then extracted with an equal volume of butyl acetate. Free fatty acids in the organic phase are derivatized with BSTFA (N,O-bis(trimethyl(silyl) trifluoro acetamide) and 1% TMCS (trimethyl chloro silane) to generate the respective TMS (trimethyl silyl-) esters, which are then analyzed on a gas chromatograph equipped with a flame ionization detector.

4-MU-6S-Palm-βGlc Assay:

A 20 µL of substrate solution is first prepared. The substrate solution contains 0.64 mM MU-6S-Palm-β-Glc, 15 mM dithiothreitol, 0.375% (w/v) Triton X-100, and 0.1 U β-glucosidase from almonds in McIlvain's phosphate/citrate buffer, pH 4.0. A culture mixture potentially having thioesterase activity is then mixed with the substrate solution. The reaction mixture is incubated for 1 hour at 37° C. Exogenous almond β-glucosidase is added to hydrolyze the reaction intermediate, MU-6-thio-β-glucoside, quantitatively. The hydrolysis reaction is terminated by the addition of 200 µL of 0.5 M sodium carbonate, pH 10.7, containing 0.025% Triton X-100, and the fluorescence of the released 4-methylumbelliferone (MU) is measured in a fluorometer ($\lambda_{ex}$=372, $\lambda_{em}$=445 nm).

Lysophospholipase Assay:

A reaction mixture containing 10 µL a culture mixture potentially having thioesterase activity mixed with 10 µL of 3 mM 1-oleoyl-phosphatidylethanolamine, 25 µL of 100 mM Tris-HCl (pH 7.0), and 5 µL of 5 mM EDTA is prepared. The reaction is terminated with the addition of 1.5 mL $CHCl_3$:$CH_3OH$ (1:2), followed by the addition of water to bring the total aqueous volume to 0.9 mL. The organic phase is then analyzed by thin layer chromatography together with suitable standards, using plates prepared from 40 g Silica Gel H suspended in 95 mL of 1 mM sodium tetraborate. The solvent system consists of $CHCl_3$:$CH_3OH$:$H_2O$ (95:35:5).

Protease Substrate Assay:

A reaction mixture containing 10 µL of a culture mixture potentially having thioesterase activity mixed with 800 µL 12.5 mM Tris-HCl (pH 8.0) containing 0.25% Triton X-100 and 10 µL of Cbz-Phe-ONp dissolved in DMSO is prepared. The p-nitrophenol released via cleavage of the substrate is measured by monitoring the absorbance at 405 nm.

Fatty Acyl-PNP Hydrolysis Assay:

A reagent solution containing 2% Triton X-100 in 50 mM sodium phosphate, pH 7.0, and 10 mM $C_{12}$-p-nitrophenol (acyl-PNP) in acetone is first prepared. Then a $C_{12}$-PNP working solution is prepared by mixing 600 µL 10 mM $C_{12}$-PNP into a 9.4-mL phosphate buffer. The assay is performed by adding 40 µL of the acyl-PNP working solution to each well of a 96-well plate, followed by the rapid addition of 40 µL of the culture mixture potentially having thioesterase activity. The solution is mixed for 15 seconds, and the absorbance change is read at 405 nm in a microtiter plate reader at 25° C.

Ester Formation from Thioester:

A reaction mixture containing a culture mixture potentially having thioesterase activity, 100 µM myristoyl-CoA, 10% (v/v) methanol, and 50 mM sodium phosphate, pH 7.0 is prepared. The reaction mixture is incubated for 1 hour at 20° C. and terminated with the addition of 1 N HCl to decrease the pH to about 2.5. The mixture is extracted with an equal volume of ethyl acetate and the amount of fatty ester produced is determined via GC-MS or other standard methods such as GC-FID, LC-MS, or thin layer chromatography.

Ester Formation from Ester:

A reaction mixture containing a culture mixture potentially having thioesterase activity, 300 µM lauroyl-CoA, 10% (v/v) methanol, and 50 mM sodium phosphate, pH 7.0 is prepared. The reaction mixture is incubated for 1 hour at 20° C. and terminated with the addition of 1 N HCl to decrease the pH to about 2.5. The mixture is extracted with an equal volume of ethyl acetate and the amount of lauryl ester produced is determined via GC-MS or other standard methods such as GC-FID, LC-MS, or thin layer chromatography.

Thus, an endogenous thioesterase can be attenuated and/or functionally deleted from the host cells of the present invention. In certain embodiments the thioesterase is selected from the group consisting of tesA, 'tesA, fatB1, fatB2, fatB3, fatA1, fatA, and atfata. Non-limiting examples of thioesterases and host cells are listed in Table 1.

TABLE 1

Thioesterases

| Accession Number | Source Organism | Gene |
|---|---|---|
| AAC73596 | E. coli | tesA without leader sequence |
| AAC73555 | E. coli | tesB |
| Q41635, AAA34215 | Umbellularia california | fatB |
| AAC49269 | Cuphea hookeriana | fatB2 |
| Q39513; AAC72881 | Cuphea hookeriana | fatB3 |
| Q39473, AAC49151 | Cinnamonum camphorum | fatB |
| CAA85388 | Arabidopsis thaliana | fatB [M141T]* |
| NP 189147; NP 193041 | Arabidopsis thaliana | fatA |
| CAC39106 | Bradyrhiizobium japonicum | fatA |
| AAC72883 | Cuphea hookeriana | fatA |
| AAL79361 | Helianthus annus | fatA1 |

*Mayer et al., BMC Plant Biology 7: 1-11 (2007)

In other instances, fatty acids and/or fatty acid derivatives are produced in a host cell that contains one or more naturally-occurring mutations that result in an increased level of fatty acids and/or fatty acid derivatives in the host cell. In some instances, the host cell is genetically engineered to increase the level of fatty acids and/or fatty acid derivatives in the host cell relative to a corresponding wild-type host cell. For example, the host cell can be genetically engineered to express a reduced level of a fatty acid degradation enzyme such as an acyl-CoA synthase relative to a corresponding wild-type host cell. In one embodiment, the level of expression of one or more genes (e.g., an acyl-CoA synthase gene) is attenuated or functionally deleted by genetically engineering a "knock out" host cell.

Any known acyl-CoA synthase gene can be reduced or functionally deleted in a host cell. Non-limiting examples of acyl-CoA synthase genes include fadD, fadK, BH3103, yhfL, Pfl-4354, EAV15023, fadD1, fadD2, RPC_4074, fadDD35, fadDD22, faa3p or the gene encoding the protein ZP_01644857. Specific examples of acyl-CoA synthase genes include fadDD35 from M. tuberculosis H37Rv [NP_217021], fadDD22 from M. tuberculosis H37Rv [NP_217464], fadD from E. coli [NP_416319], fadK from E. coli [YP_416216], fadD from Acinetobacter sp. ADP1 [YP_045024], fadD from Haemophilus influenza RdkW20 [NP_438551], fadD from Rhodopseudomonas palustris Bis B18 [YP_533919], BH3101 from Bacillus halodurans C-125 [NP_243969], Pfl-4354 from Pseudomonas fluorescens Pfo-1 [YP_350082], EAV15023 from Comamonas testosterone KF-1 [ZP_01520072], yhfL from B. subtilis [NP_388908], fadD1 from P. aeruginosa PAO1 [NP_251989], fadD1 from Ralstonia solanacearum GM1 1000 [NP_520978], fadD2 from P. aeruginosa PAO1 [NP_251990], the gene encoding the protein ZP_01644857 from Stenotrophomonas maltophilia R551-3, faa3p from Saccharomyces cerevisiae [NP_012257], faa1p from Saccharomyces cerevisiae [NP_014962], lcfA from Bacillus subtilis [CAA99571], or those described in Shockey et al., Plant. Physiol. 129:1710-1722 (2002); Caviglia et al., J. Biol. Chem. 279:1163-1169 (2004); Knoll et al., J. Biol. Chem. 269(23):16348-56 (1994); Johnson et al., J. Biol. Chem. 269: 18037-18046 (1994); and Black et al., J. Biol. Chem. 267: 25513-25520 (1992).

The alcohol substrates can be supplied to the host cells. In alternative embodiments, when fatty alcohols are used as substrartes, the fatty alcohol substrates can be made by the host cell by co-expressing one or more fatty aldehyde biosynthesis genes and/or one or more fatty alcohol biosynthesis genes. Heterologous fatty aldehyde biosynthesis genes can be introduced to the host cell, or endogenous fatty aldehyde biosynthesis genes can be modified such that they are overexpressed in the host cell. Suitable fatty aldehyde biosynthesis genes include, without limitation, those encoding carboxylic acid reductases and variants of, for example, any one of SEQ ID NOs:54-97. Heterologous fatty alcohol biosynthesis genes can also be introduced to the host cell, or endogenous fatty alcohol biosynthesis genes can be modified such that they are overexpressed in the host cell. Suitable fatty alcohol biosynthesis genes include, without limitation, those encoding alcohol dehydrogenases and variants of, for example, any one of SEQ ID NOs:98-147. In additional embodiments, fatty alcohol substrates can be made by the host cell by co-expressing one or more acyl-ACP reductase genes and/or one or more fatty alcohol biosynthesis genes. Heterologous acyl-ACP reductase genes may be introduced to the host cell, or endogenous acyl-ACP reductase genes can be modified such that they are overexpressed in the host cell. Suitable acyl-ACP reductase genes include, without limitation, those encoding acyl-ACP reductases and variants of, for example, any one of SEQ ID NOs:148-156. Methods, host cells, and microorganisms of producing fatty alcohols have been previously described, for example, in International Patent Publication No. WO/2010/042664, the disclosures of which are incorporated herein by reference.

In another embodiment, the ester synthase polypeptides and variants of the present invention can catalyze the conversion of a free fatty acid into a fatty ester in the presence of suitable alcohol substrates. Accordingly, in some embodiments, when free fatty acid is not a desired product, the ester synthase polypeptides and variants of the invention can be used to reduce the amount of free fatty acid generated during the fatty ester production by converting them into fatty esters.

Formation of Branched Fatty Acids and/or Fatty Acid Derivatives

Fatty acids and derivatives thereof can be produced that contain points of branching by using branched thioester and/or branched alcohol as substrates. For example, although E. coli naturally produces straight chain fatty acids (sFAs), E. coli can be engineered to produce branched chain fatty acids (brFAs) and/or brFA derivatives by introducing and expressing or overexpressing heterologous genes that provide branched precursors in the E. coli (e.g., bkd, ilv, icm, and fab gene families). Additionally, a host cell can be engineered to express or overexpress genes encoding proteins for the elongation of brFAs (e.g., ACP, FabF, etc.) or derivatives, and/or to delete or attenuate the corresponding host cell genes that normally lead to straight-chain fatty acids and/or fatty acid derivatives.

The first step in forming brFAs or brFA derivatives is the production of the corresponding α-keto acids by a branched-chain amino acid aminotransferase. Host cells may endogenously include genes encoding such enzymes or such genes can be heterologously or recombinantly introduced. E. coli, for example, endogenously expresses such an enzyme, IlvE (EC 2.6.1.42; GenBank Accession No. YP_026247). In some host cells, a heterologous branched-chain amino acid aminotransferase may not be expressed. However, E. coli IlvE or any other branched-chain amino acid aminotransferase (e.g., IlvE from Lactococcus lactis (GenBank Accession No. AAF34406), IlvE from Pseudomonas putida (GenBank Accession No. NP_745648), or IlvE from Streptomyces coelicolor (GenBank Accession No. NP_629657)), if not endogenous, can be introduced.

In another embodiment, the production of α-keto acids can be achieved by using the methods described in Atsumi et al., Nature 451:86-89 (2008). For example, 2-ketoisovalerate can be produced by overexpressing the genes encoding IlvI, IlvH, IlvC, or IlvD. In another example, 2-keto-3-methyl-valerate can be produced by overexpressing the genes encoding IlvA and IlvI, IlvH (or AlsS of *Bacillus subtilis*), IlvC, IlvD, or their corresponding homologs. In a further embodiment, 2-keto-4-methyl-pentanoate can be produced by overexpressing the genes encoding IlvI, IlvH, IlvC, IlvD and LeuA, LeuB, LeuC, LeuD, or their corresponding homologs.

The second step is the oxidative decarboxylation of the α-keto acids to the corresponding branched-chain acyl-CoA. This reaction can be catalyzed by a branched-chain α-keto acid dehydrogenase complex (bkd; EC 1.2.4.4.) (Denoya et al., *J. Bacteria* 177:3504 (1995), which consists of E1α/β (decarboxylase), E2 (dihydrolipoyl transacylase), and E3 (dihydrolipoyl dehydrogenase) subunits. These branched-chain α-keto acid dehydrogenase complexes are similar to pyruvate and α-ketoglutarate dehydrogenase complexes. Any microorganism that comprises brFAs and/or brFA cellular components and/or is capable of growing on branched-chain amino acids can be used as a source to isolate bkd genes for expression in host cells, for example, *E. coli*. Furthermore, *E. coli* has the E3 component as part of its pyruvate dehydrogenase complex (lpd, EC 1.8.1.4, GenBank Accession No. NP_414658). Thus, it may be sufficient to express only the E1 α/β and E2 bkd genes. Table 2 lists non-limiting examples of bkd genes from several microorganisms that can be heterologously or recombinantly introduced and expressed in a host cell to provide branched-chain acyl-CoA precursors.

TABLE 2

Bkd genes from selected microorganisms

| Organism | Gene | GenBank Accession # |
|---|---|---|
| *Streptomyces coelicolor* | bkdA1 (E1α) | NP_628006 |
| | bkdB1 (E1β) | NP_628005 |
| | bkdC1 (E2) | NP_628004 |
| *Streptomyces coelicolor* | bkdA2 (E1α) | NP_733618 |
| | bkdB2 (E1β) | NP_628019 |
| | bkdC2 (E2) | NP_628018 |
| *Streptomyces avermitilis* | bkdA (E1a) | BAC72074 |
| | bkdB (E1b) | BAC72075 |
| | bkdC (E2) | BAC72076 |
| *Streptomyces avermitilis* | bkdF (E1α) | BAC72088 |
| | bkdG (E1β) | BAC72089 |
| | bkdH (E2) | BAC72090 |
| *Bacillus subtilis* | bkdAA (E1α) | NP_390288 |
| | bkdAB (E1β) | NP_390288 |
| | bkdB (E2) | NP_390288 |
| *Pseudomonas putida* | bkdA1 (E1α) | AAA65614 |
| | bkdA2 (E1β) | AAA65615 |
| | bkdC (E2) | AAA65617 |

In another example, isobutyryl-CoA can be made in a host cell, for example in *E. coli*, through the coexpression of a crotonyl-CoA reductase (Ccr, EC 1.6.5.5, 1.1.1.1) and isobutyryl-CoA mutase (large subunit IcmA, EC 5.4.99.2; small subunit IcmB, EC 5.4.99.2) (Han and Reynolds, *J. Bacteriol.* 179:5157 (1997)). Crotonyl-CoA is an intermediate in fatty acid biosynthesis in *E. coli* and other microorganisms. Non-limiting examples of ccr and icm genes from selected microorganisms are listed in Table 3.

TABLE 3

Ccr and icm genes from selected microorganisms

| Organism | Gene | GenBank Accession # |
|---|---|---|
| *Streptomyces coelicolor* | ccr | NP_630556 |
| | icmA | NP_629554 |
| | icmB | NP_630904 |

TABLE 3-continued

Ccr and icm genes from selected microorganisms

| Organism | Gene | GenBank Accession # |
|---|---|---|
| *Streptomyces cinnamonensis* | ccr | AAD53915 |
| | icmA | AAC08713 |
| | icmB | AJ246005 |

In addition to expression of the bkd genes, the initiation of brFA biosynthesis utilizes β-ketoacyl-acyl-carrier-protein synthase III (FabH, EC 2.3.1.41) with specificity for branched chain acyl-CoAs (Li et al., *J. Bacteriol.* 187:3795-3799 (2005)). Non-limiting examples of FabH enzymes are listed in Table 4. fabH genes that are involved in fatty acid biosynthesis of any brFA-containing microorganism or organisms that feed on branched-chain amino acids can be expressed in a host cell. The Bkd and FabH enzymes from host cells that do not naturally make brFA may not support brFA production. Thus, bkd and fabH can be expressed recombinantly or heterologously. Vectors containing the bkd and/or fabH genes can be inserted into such a host cell. Similarly, the endogenous level of Bkd and FabH production may not be sufficient to produce brFA. In this case, the endogenous bkd and/or fabH can be overexpressed. Or the endogenous bkd and/or fabH can be functionally deleted and replaced with a heterologous bkd and/or fabH. Preferably, the heterologous bkd and/or fabH that is introduced into a host cell encode more effective BKD and/or FabH enzymes than those encoded by the endogenous bkd and/or fabH. Additionally, other components of the fatty acid biosynthesis pathway can be expressed or overexpressed, such as acyl carrier proteins (ACPs) and β-ketoacyl-acyl-carrier-protein synthase II (fabF, EC 2.3.1.41) (non-limiting examples are listed in Table 4). In addition to expressing these genes, some genes in the endogenous fatty acid biosynthesis pathway can be attenuated in the host cell (e.g., the *E. coli* genes fabH (GenBank Accession No. NP_415609) and/or fabF (GenBank Accession No. NP_415613)).

TABLE 4

FabH, ACP and fabF genes from selected microorganisms with brFAs

| Organism | Gene | GenBank Accession # |
|---|---|---|
| *Streptomyces coelicolor* | fabH1 | NP_626634 |
| | acp | NP_626635 |
| | fabF | NP_626636 |
| *Streptomyces avermitilis* | fabH3 | NP_823466 |
| | fabC3 (acp) | NP_823467 |
| | fabF | NP_823468 |
| *Bacillus subtilis* | fabH_A | NP_389015 |
| | fabH_B | NP_388898 |
| | acp | NP_389474 |
| | fabF | NP_389016 |
| *Stenotrophomonas maltophilia* | SmalDRAFT_0818 (fabH) | ZP_01643059 |
| | SmalDRAFT_0821 (acp) | ZP_01643063 |
| | SmalDRAFT_0822 (fabF) | ZP_01643064 |
| *Legionella pneumophila* | fabH | YP_123672 |
| | acp | YP_123675 |
| | fabF | YP_123676 |

Formation of Cyclic Fatty Acids and/or Fatty Acid Derivatives

Cyclic fatty acids and/or derivatives thereof such as, for example, cyclic fatty esters, can be produced by using suitable cyclic substrates. To produce cyclic substrates, genes that provide cyclic precursors (e.g., the ans, chc, and plm gene families) can be introduced into the host cell and expressed to allow initiation of fatty acid biosynthesis from cyclic precursors. For example, to convert a host cell, such as E. coli, into one capable of synthesizing ω-cyclic fatty acids (cyFA), a gene that provides the cyclic precursor cyclohexylcarbonyl-CoA (CHC-CoA) (Cropp et al., Nature Biotech. 18:980-983 (2000)) can be introduced and expressed in the host cell. Non-limiting examples of genes that provide CHC-CoA in E. coli include: ansJ, ansK, ansL, chcA, and ansM from the ansatrienin gene cluster of Streptomyces collinus (Chen et al., Eur. J. Biochem. 261: 98-107 (1999)) or plmJ, plmK, plmL, chcA, and plmM from the phoslactomycin B gene cluster of Streptomyces sp. HK803 (Palaniappan et al., J. Biol. Chem. 278:35552-57 (2003)) together with the chcB gene (Patton et al., Biochem. 39:7595-7604 (2000)) from S. collinus, S. avermitilis, or S. coelicolor (see Table 5). The genes listed in Table 4 can then be expressed to allow initiation and elongation of ω-cyclic fatty acids. Alternatively, the homologous genes can be isolated from microorganisms that make cyFA and expressed in a host cell (e.g., E. coli).

TABLE 5

Genes for the synthesis of CHC-CoA

| Organism | Gene | GenBank Accession # |
|---|---|---|
| Streptomyces collinus | ansJK | U72144* |
| | ansL | |
| | chcA | |
| | ansM | |
| | chcB | AF268489 |
| Streptomyces sp. HK803 | pmlJK | AAQ84158 |
| | pmlL | AAQ84159 |
| | chcA | AAQ84160 |
| | pmlM | AAQ84161 |
| Streptomyces coelicolor | chcB/caiD | NP_629292 |
| Streptomyces avermitilis | chcB/caiD | NP_629292 |

*Only chcA is annotated in GenBank entry U72144, ansJKLM are according to Chen et al. (Eur. J. Biochem. 261: 98-107, 1999).

The genes listed in Table 4, supra (fabH, acp, and fabF) allow initiation and elongation of co-cyclic fatty acids because they have broad substrate specificity. If the coexpression of any of these genes with the genes listed in Table 5 does not yield cyFA, then fabH, acp, and/or fabF homologs from microorganisms that make cyFAs (e.g., those listed in Table 6) can be isolated (e.g., by using degenerate PCR primers or heterologous DNA sequence probes) and coexpressed.

TABLE 6

Non-limiting examples of microorganisms that contain ω-cyclic fatty acids

| Organism | Reference |
|---|---|
| Curtobacterium pusillum | ATCC19096 |
| Alicyclobacillus acidoterrestris | ATCC49025 |
| Alicyclobacillus acidocaldarius | ATCC27009 |
| Alicyclobacillus cycloheptanicus* | Moore, J. Org. Chem. 62: pp. 2173, 1997 |

*Uses cycloheptylcarbonyl-CoA and not cyclohexylcarbonyl-CoA as precursor for cyFA biosynthesis.

Fatty Acids and Fatty Acid Derivatives Saturation Levels

The degree of saturation in fatty acids and/or derivatives thereof can be controlled by regulating the degree of saturation of intermediates. For example, the sfa, gns, and fab families of genes can be expressed, overexpressed, or expressed at reduced levels, to control the saturation of fatty acids. Exemplary genes include, without limitation, fabB (EC 2.3.1.41), fabK (EC 1.3.1.9), fabL (EC 1.3.1.9), fabM (EC 4.2.1.17), which can be used in the methods and host cells described herein.

For example, host cells can be engineered to produce unsaturated fatty acids and/or fatty acid derivatives by engineering the production host to overexpress fabB or by growing the production host at low temperatures (e.g., less than 37° C.). FabB has preference to cis-δ3decenoyl-ACP and results in unsaturated fatty acid production in E. coli. Overexpression of fabB results in the production of a significant percentage of unsaturated fatty acids and/or fatty acid derivatives (de Mendoza et al., J. Biol. Chem. 258:2098-2101 (1983)). The gene fabB may be inserted into and expressed in host cells not naturally having the gene. These unsaturated fatty acids and/or fatty acid derivatives can then be used as intermediates in host cells.

In other instances, a repressor of fatty acid biosynthesis, for example, fabR (GenBank Accession No. NP_418398), can be deleted, which will also result in increased unsaturated fatty acid and/or fatty acid derivative production in E. coli (Zhang et al., J. Biol. Chem. 277:15558 (2002)). Similar deletions may be made in other host cells. A further increase in unsaturated fatty acids may be achieved, for example, by overexpressing fabM (trans-2, cis-3-decenoyl-ACP isomerase, GenBank Accession No. DAA05501) and controlled expression offabK (trans-2-enoyl-ACP reductase II, GenBank Accession No. NP_357969) from Streptococcus pneumoniae (Marrakchi et al., J. Biol. Chem. 277: 44809 (2002)), while deleting E. coli fabI (trans-2-enoyl-ACP reductase, GenBank Accession No. NP_415804). In some examples, the endogenous fabF gene can be attenuated, thus increasing the percentage of palmitoleate (C16:1) produced.

In yet other examples, host cells can be engineered to produce saturated fatty acids by reducing the expression of an sfa, gns, or fab gene.

For example, a host cell can be engineered to express a decreased level of fabA and/or fabB. In some instances, the host cell can be grown in the presence of unsaturated fatty acids. In other instances, the host cell can be further engineered to express or overexpress a gene encoding a desaturase enzyme. One nonlimiting example of a desaturase is B. subtilis DesA (AF037430). Other genes encoding desaturase enzymes are known in the art and can be used in the host cells and methods described herein, such as desaturases that use acyl-ACP, such as hexadecanoyl-ACP or octadecanoyl-ACP.

Genetic Engineering of Host Cells to Produce Fatty Acids and/or Fatty Acid Derivatives Various host cells can be used to produce fatty acids and/or fatty acid derivatives, as described herein. A host cell can be any prokaryotic or eukaryotic cell. For example, a polypeptide described herein can be expressed in bacterial cells (such as E. coli), insect cells, yeast, or mammalian cells (such as Chinese hamster ovary cells (CHO) cells, COS cells, VERO cells, BHK cells, HeLa cells, Cvl cells, MDCK cells, 293 cells, 3T3 cells, or PC12 cells). Other exemplary host cells include cells from the members of the genus Escherichia, Bacillus, Lactobacillus, Rhodococcus, Pseudomonas, Aspergillus, Trichoderma, Neurospora, Fusarium, Humicola, Rhizomucor, Kluyveromyces, Pichia, Mucor, Myceliophtora, Penicillium, Phanerochaete, Pleurotus, Trametes, Chrysosporium, Saccharomyces, Schizosaccharomyces, Yarrowia, or Streptomyces. Yet other exemplary host cells can be a cell of Bacillus lentus, Bacillus brevis, Bacillus stearothermophilus, Bacillus licheniformis, Bacillus alkalophilus, Bacillus coagulans, Bacillus circulans, Bacillus pumilis, Bacillus thuringiensis, Bacillus clausii, Bacillus megaterium, Bacillus subtilis, Bacillus amyloliquefaciens, Trichoderma koningii, Trichoderma viride, Trichoderma reesei, Trichoderma longibrachiatum, Aspergillus awamori, Aspergillus fumigates, Aspergillus foetidus, Aspergillus nidulans,

*Aspergillus niger, Aspergillus oryzae, Humicola insolens, Humicola lanuginose, Rhizomucor miehei, Mucor michei, Streptomyces lividans, Streptomyces murinus*, or *Actinomycetes*. Other host cells are cyanobacterial host cells.

In a preferred embodiment, the host cell is an *E. coli* cell, a *Saccharomyces cerevisiae* cell, or a *Bacillus subtilis* cell. In a more preferred embodiment, the host cell is from *E. coli* strains B, C, K, or W. Other suitable host cells are known to those skilled in the art.

Various methods well known in the art can be used to genetically engineer host cells to produce fatty acids and/or fatty acid derivatives. The methods can include the use of vectors, preferably expression vectors, containing a nucleic acid encoding an ester synthase polypeptide described herein, polypeptide variant, or a fragment thereof. Those skilled in the art will appreciate a variety of viral vectors (for example, retroviral vectors, lentiviral vectors, adenoviral vectors, and adeno-associated viral vectors) and non-viral vectors can be used in the methods described herein.

The recombinant expression vectors described herein include a nucleic acid described herein in a form suitable for expression of the nucleic acid in a host cell. The recombinant expression vectors can include one or more control sequences, selected on the basis of the host cell to be used for expression. The control sequence is operably linked to the nucleic acid sequence to be expressed. Such control sequences are described, for example, in Goeddel, Gene Expression Technology: Methods in Enzymology 185, Academic Press, San Diego, Calif. (1990). Control sequences include those that direct constitutive expression of a nucleotide sequence in many types of host cells and those that direct expression of the nucleotide sequence only in certain host cells (e.g., tissue-specific regulatory sequences). It will be appreciated by those skilled in the art that the design of the expression vector can depend on such factors as the choice of the host cell to be transformed, the level of expression of protein desired, etc. The expression vectors described herein can be introduced into host cells to produce polypeptides, including fusion polypeptides, encoded by the nucleic acids as described herein.

Recombinant expression vectors can be designed for expression of a fatty acid biosynthetic polypeptide or variant in prokaryotic or eukaryotic cells (e.g., bacterial cells, such as *E. coli*t, insect cells (e.g., using baculovirus expression vectors), yeast cells, or mammalian cells). Suitable host cells are discussed further in Goeddel, Gene Expression Technology: Methods in Enzymology 185, Academic Press, San Diego, Calif. (1990). Alternatively, the recombinant expression vector can be transcribed and translated in vitro, for example, by using T7 promoter regulatory sequences and T7 polymerase.

Expression of polypeptides in prokaryotes, for example, *E. coli*, is most often carried out with vectors containing constitutive or inducible promoters directing the expression of either fusion or non-fusion polypeptides. Fusion vectors add a number of amino acids to a polypeptide encoded therein, usually to the amino terminus of the recombinant polypeptide. Such fusion vectors typically serve three purposes: (1) to increase expression of the recombinant polypeptide; (2) to increase the solubility of the recombinant polypeptide; and (3) to aid in the purification of the recombinant polypeptide by acting as a ligand in affinity purification. Often, in fusion expression vectors, a proteolytic cleavage site is introduced at the junction of the fusion moiety and the recombinant polypeptide. This enables separation of the recombinant polypeptide from the fusion moiety after purification of the fusion polypeptide. Examples of such enzymes, and their cognate recognition sequences, include Factor Xa, thrombin, and enterokinase. Exemplary fusion expression vectors include pGEX (Pharmacia Biotech Inc; Smith et al., *Gene* 67:31-40 (1988)), pMAL (New England Biolabs, Ipswich, Mass.), and pRITS (Pharmacia, Piscataway, N.J.), which fuse glutathione S-transferase (GST), maltose E binding protein, or protein A, respectively, to the target recombinant polypeptide.

Examples of inducible, non-fusion *E. coli* expression vectors include pTrc (Amann et al., *Gene* 69:301-315 (1988)) and pET 11d (Stauder et al., Gene Expression Technology Methods in Enzymology 185, Academic Press, San Diego, Calif. 60-89 (1990)). Target gene expression from the pTrc vector relies on host RNA polymerase transcription from a hybrid tip-lac fusion promoter. Target gene expression from the pET 11d vector relies on transcription from a T7 gn 10-lac fusion promoter mediated by a coexpressed viral RNA polymerase (T7 gnl). This viral polymerase is supplied by host strains BL21(DE3) or HMS174(DE3) from a resident λ prophage harboring a T7 gnl gene under the transcriptional control of the lacUV 5 promoter.

One strategy to maximize recombinant polypeptide expression is to express the polypeptide in a host cell with an impaired capacity to proteolytically cleave the recombinant polypeptide (see Gottesman, Gene Expression Technology: Methods in Enzymology 185, Academic Press, San Diego, Calif. 119-128 (1990)). Another strategy is to alter the nucleic acid sequence to be inserted into an expression vector so that the individual codons for each amino acid are those preferentially utilized in the host cell (Wada et al., *Nucleic Acids Res.* 20:2111-2118 (1992)). Such alteration of nucleic acid sequences can be carried out by standard DNA synthesis techniques.

In another embodiment, the host cell is a yeast cell. In this embodiment, the expression vector is a yeast expression vector. Examples of vectors for expression in yeast *S. cerevisiae* include pYepSec1 (Baldari et al., *EMBO J.* 6:229-234 (1987)), pMFa (Kurjan et al., *Cell* 30:933-943 (1982)), pJRy88 (Schultz et al., *Gene* 54:113-123 (1987)), pYES2 (Invitrogen Corporation, San Diego, Calif.), picZ (Invitrogen Corp, San Diego, Calif.), and pRS425 (Christianson et al., *Gene* 110:119-122 (1992)).

Alternatively, a polypeptide described herein can be expressed in insect cells using baculovirus expression vectors. Baculovirus vectors available for expression of proteins in cultured insect cells (e.g., Sf9 cells) include, for example, the pAc series (Smith et al., *Mol. Cell. Biol.* 3:2156-2165 (1983)) and the pVL series (Lucklow et al., *Virology* 170:31-39 (1989)).

In yet another embodiment, the nucleic acids described herein can be expressed in mammalian cells using a mammalian expression vector. Examples of mammalian expression vectors include pCDM8 (Seed, *Nature* 329:840 (1987)) and pMT2PC (Kaufman et al., *EMBO J.* 6:187-195 (1987)). When used in mammalian cells, the expression vector's control functions can be provided by viral regulatory elements. For example, commonly used promoters are derived from polyoma, Adenovirus 2, cytomegalovirus, and Simian Virus 40. Other suitable expression systems for both prokaryotic and eukaryotic cells are described in chapters 16 and 17 of Sambrook et al., eds., Molecular Cloning: A Laboratory Manual. 2nd, ed., Cold Spring Harbor Laboratory, Cold Spring Harbor Laboratory Press, Cold Spring Harbor, N.Y., 1989.

Vectors can be introduced into prokaryotic or eukaryotic cells via conventional transformation or transfection techniques. As used herein, the terms "transformation" and "transfection" refer to a variety of art-recognized techniques for introducing foreign nucleic acid (e.g., DNA) into a host cell, including calcium phosphate or calcium chloride co-precipitation, DEAE-dextran-mediated transfection, lipofection, or electroporation. Suitable methods for transforming or transfecting host cells can be found in, for example, Sambrook et al. (supra).

For stable transformation of bacterial cells, it is known that, depending upon the expression vector and transformation technique used, only a small fraction of cells will take-up and replicate the expression vector. In order to identify and select these transformants, a gene that encodes a selectable marker (e.g., resistance to antibiotics) can be introduced into the host cells along with the gene of interest. Selectable markers include those that confer resistance to drugs, such as ampicillin, kanamycin, chloramphenicol, or tetracycline. Nucleic acids encoding a selectable marker can be introduced into a host cell on the same vector as that encoding a polypeptide described herein or can be introduced on a separate vector. Cells stably transfected with the introduced nucleic acid can be identified by drug selection (e.g., cells that have incorporated the selectable marker gene will survive, while the other cells die).

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., resistance to antibiotics) can be introduced into the host cells along with the gene of interest. Preferred selectable markers include those which confer resistance to drugs, such as G418, hygromycin, and methotrexate. Nucleic acids encoding a selectable marker can be introduced into a host cell on the same vector as that encoding a polypeptide described herein or can be introduced on a separate vector. Cells stably transfected with the introduced nucleic acid can be identified by drug selection (e.g., cells that have incorporated the selectable marker gene will survive, while the other cells die).

Transport Proteins

Transport proteins can export polypeptides (e.g., ester synthase) and organic compounds (e.g., fatty acids, fatty acid derivatives) out of a host cell. Many transport and efflux proteins serve to excrete a wide variety of compounds and can be naturally modified to be selective for particular types of hydrocarbons.

Non-limiting examples of suitable transport proteins are ATP-Binding Cassette (ABC) transport proteins, efflux proteins, and fatty acid transporter proteins (FATP). Additional non-limiting examples of suitable transport proteins include the ABC transport proteins from organisms such as *Caenorhabditis elegans, Arabidopsis thalania, Alkaligenes eutrophus,* and *Rhodococcus erythropolis*. Exemplary ABC transport proteins that can be used include, without limitation, CER5, AtMRP5, AmiS2, AtPGP1, AcrA, AcrB, TolC, AcrE, AcrF, tll1618, tll1619, and tll0139. Host cells can also be chosen for their endogenous ability to secrete organic compounds. The efficiency of organic compound production and secretion into the host cell environment (e.g., culture medium, fermentation broth) can be expressed as a ratio of intracellular product to extracellular product. In some examples, the ratio can be about 5:1, 4:1, 3:1, 2:1, 1:1, 1:2, 1:3, 1:4, or 1:5.

Fermentation

The production and isolation of fatty acids and/or derivatives thereof produced according to the present disclosure can be enhanced by employing beneficial fermentation techniques. One method for maximizing production while reducing costs is increasing the percentage of the carbon source that is converted to hydrocarbon products.

During normal cellular lifecycles, carbon is used in cellular functions, such as producing lipids, saccharides, proteins, organic acids, and nucleic acids. Reducing the amount of carbon necessary for growth-related activities can increase the efficiency of carbon source conversion to product. This can be achieved by, for example, first growing host cells to a desired density (for example, a density achieved at the peak of the log phase of growth). At such a point, replication checkpoint genes can be harnessed to stop the growth of cells. Specifically, quorum sensing mechanisms (reviewed in Camilli et al., *Science* 311:1113 (2006); Venturi, *FEMS Microbio. Rev.* 30:274-291 (2006); and Reading et al., *FEMS Microbiol. Lett.* 254:1-11 (2006)) can be used to activate checkpoint genes, such as p53, p21, or other checkpoint genes.

Genes that can be activated to stop cell replication and growth in *E. coli* include umuDC genes. The overexpression of umuDC genes stops the progression from stationary phase to exponential growth (Murli et al., *J. of Bact.* 182:1127 (2000)). UmuC is a DNA polymerase that can carry out translesion synthesis over non-coding lesions—the mechanistic basis of most UV and chemical mutagenesis. The umuDC gene products are involved in the process of translesion synthesis and also serve as a DNA sequence damage checkpoint. The umuDC gene products include UmuC, UmuD, umuD', UmuD'$_2$C, UmuD'$_2$, and UmuD$_2$. Simultaneously, product-producing genes can be activated, thus minimizing the need for replication and maintenance pathways to be used while a fatty aldehyde is being made. Host cells can also be engineered to express umuC and umuD from *E. coli* in pBAD24 under the prpBCDE promoter system through de novo synthesis of this gene with the appropriate end-product production genes.

The percentage of input carbons converted to fatty acids and/or fatty acid derivatives can be a cost driver. The more efficient the process is (i.e., the higher the percentage of input carbons converted to fatty acids and/or fatty acid derivatives), the less expensive the process will be. For oxygen-containing carbon sources (e.g., glucose and other carbohydrate based sources), the oxygen must be released in the form of carbon dioxide. For every 2 oxygen atoms released, a carbon atom is also released leading to a maximal theoretical metabolic efficiency of about 34% (w/w) (for fatty acid derived products). This figure, however, changes for other organic compounds and carbon sources. Typical efficiencies in the literature are about less than 5%. Host cells engineered to produce fatty acids and/or fatty acid derivatives can have greater than about 1, 3, 5, 10, 15, 20, 25, and 30% efficiency. In one example, host cells can exhibit an efficiency of about 10% to about 25%. In other examples, such host cells can exhibit an efficiency of about 25% to about 30%. In other examples, host cells can exhibit greater than 30% efficiency.

The host cell can be additionally engineered to express recombinant cellulosomes, such as those described in PCT application number PCT/US2007/003736. These cellulosomes can allow the host cell to use cellulosic material as a carbon source. For example, the host cell can be additionally engineered to express invertases (EC 3.2.1.26) so that sucrose can be used as a carbon source. Similarly, the host cell can be engineered using the teachings described in U.S. Pat. Nos. 5,000,000; 5,028,539; 5,424,202; 5,482,846; and 5,602,030; so that the host cell can assimilate carbon efficiently and use cellulosic materials as carbon sources.

In one example, the fermentation chamber can enclose a fermentation that is undergoing a continuous reduction. In this instance, a stable reductive environment can be created.

The electron balance can be maintained by the release of carbon dioxide (in gaseous form). Efforts to augment the NAD/H and NADP/H balance can also facilitate in stabilizing the electron balance. The availability of intracellular NADPH can also be enhanced by engineering the host cell to express an NADH:NADPH transhydrogenase. The expression of one or more NADH:NADPH transhydrogenases converts the NADH produced in glycolysis to NADPH, which can enhance the production of fatty acids and/or fatty acid derivatives.

For small scale production, the engineered host cells can be grown in batches of, for example, about 100 mL, 500 mL, 1 L, 2 L, 5 L, or 10 L; fermented; and induced to express desired biosynthetic genes based on the specific genes encoded in the appropriate plasmids. For large scale production, the engineered host cells can be grown in batches of about 10 L, 100 L, 1000 L, 10,000 L, 100,000 L, 1,000,000 L or larger; fermented; and induced to express desired biosynthetic genes based on the specific genes encoded in the appropriate plasmids or incorporated into the host cell's genome.

For example, a suitable production host, such as *E. coli* cells, harboring plasmids containing the desired biosynthetic genes or having the biosynthetic genes integrated in its chromosome can be incubated in a suitable reactor, for example a 1 L reactor, for 20 hours at 37° C. in an M9 medium supplemented with 2% glucose, carbenicillin, and chloramphenicol. When the $OD_{600}$ of the culture reaches about 0.9, the production host can be induced with IPTG to activate the engineered gene systems for fatty acid/fatty acid derivative production. After incubation, the spent medium can be extracted and the organic phase can be examined for the presence of fatty acids/fatty acid derivatives using known detection methods such as, for example, GC-MS.

In some instances, after the first hour of induction, aliquots of no more than about 10% of the total cell volume can be removed each hour and allowed to sit without agitation to allow the fatty acid esters to rise to the surface and undergo a spontaneous phase separation or precipitation. The fatty acid/fatty acid derivative component can then be collected, and the aqueous phase returned to the reaction chamber. The reaction chamber can be operated continuously. When the $OD_{600}$ drops below about 0.6, the cells can be replaced with a new batch grown from a seed culture.

Glucose

In some instances, the methods disclosed herein are performed using glucose as a carbon source. In certain instances, microorganisms are grown in a culture medium containing an initial glucose concentration of about 2 g/L to about 50 g/L, such as about 5 g/L to about 20 g/L. In some instances, the glucose concentration of the culture medium decreases from the initial glucose concentration as the microorganisms consume the glucose, and a concentration of about 0 g/L to about 5 g/L glucose is maintained in the culture medium during the fatty acid/fatty acid derivative production process. In certain instances, glucose is fed to the microorganisms in a solution of about 50% to about 65% glucose.

In some instances, the feed rate of glucose is set to match the cells' growth rate to avoid excess accumulation of glucose (i.e., >0% glucose) in the fermentor. In other instances, and a low concentration of excess glucose (e.g., about 2 g/L to about 5 g/L) is maintained.

In certain instances, fatty acids and/or fatty acid derivatives can be produced from carbohydrates other than glucose, including but not limited to fructose, hydrolyzed sucrose, hydrolyzed molasses and glycerol.

Post-Production Processing

The fatty acids and/or fatty acid derivatives produced during fermentation can be separated from the fermentation media. Any known technique for separating fatty acids and/or fatty acid derivatives from aqueous media can be used. One exemplary separation process is a two phase (bi-phasic) separation process. This process involves fermenting the genetically engineered host cells under conditions sufficient to produce a fatty acid and/or fatty acid derivative, allowing the fatty acid and/or fatty acid derivative to collect in an organic phase, and separating the organic phase from the aqueous fermentation broth. This method can be practiced in both a batch and continuous fermentation processes.

Bi-phasic separation uses the relative immiscibility of fatty acids and/or fatty acid derivatives to facilitate separation. Immiscible refers to the relative inability of a compound to dissolve in water and is defined by the compound's partition coefficient. One of ordinary skill in the art will appreciate that by choosing a fermentation broth and organic phase, such that the fatty acid and/or fatty acid derivative being produced has a high log P value, the fatty acid and/or fatty acid derivative can separate into the organic phase, even at very low concentrations, in the fermentation vessel.

The fatty acids and/or fatty acid derivatives produced by the methods described herein can be relatively immiscible in the fermentation broth, as well as in the cytoplasm. Therefore, the fatty acids and/or fatty acid derivative can collect in an organic phase either intracellularly or extracellularly. The collection of the products in the organic phase can lessen the impact of the fatty acid and/or fatty acid derivative on cellular function and can allow the host cell to produce more product.

The methods described herein can result in the production of homogeneous compounds wherein at least about 60%, 70%, 80%, 90%, or 95% of the fatty acids and/or fatty acid derivatives produced will have carbon chain lengths that vary by less than about 8 carbons, less than about 6 carbons, less than about 4 carbons, or less than about 2 carbons. These compounds can also be produced with a relatively uniform degree of saturation. These compounds can be used directly as fuels, fuel additives, starting materials for production of other chemical compounds (e.g., polymers, surfactants, plastics, textiles, solvents, adhesives, etc.), or personal care additives. These compounds can also be used as feedstock for subsequent reactions, for example, hydrogenation, catalytic cracking (e.g., via hydrogenation, pyrolisis, or both), to make other products.

In some embodiments, the fatty acids and/or fatty acid derivatives produced using methods described herein can contain between about 50% and about 90% carbon; or between about 5% and about 25% hydrogen. In other embodiments, the fatty acids and/or fatty acid derivatives produced using methods described herein can contain between about 65% and about 85% carbon; or between about 10% and about 15% hydrogen.

Producing Fatty Acids and/or Fatty Acid Derivatives Using Cell-Free Methods

Certain methods described herein also encompass a fatty acid or a derivative thereof produced using a purified ester synthase polypeptide, a variant or a fragment thereof described herein and a substrate, provided or produced by, for example, a method described herein. For example, a host cell can be engineered to express a suitable ester synthase, a variant or a fragment thereof, as described herein. The host cell can be cultured under conditions that allow the expression of the ester synthase polypeptide. Cell free extracts can then be generated using known methods. For example, the host cells can be lysed using detergents or by sonication. The expressed polypeptides can then be purified or substantially purified using known methods. After obtaining the cell free extracts, substrates described herein can be provided to the cell free extracts and incubated under conditions that allow conversion of the substrates to desired fatty acids and/or fatty acid derivatives. The fatty acids and/or fatty acid derivatives can then be separated and purified using known techniques. Accordingly, fatty acids and/or fatty acid derivatives of the present invention can be produced extacellularly and isolated in vitro.

Bioproducts

Bioproducts comprising biologically produced organic compounds, particularly fatty acids and fatty acid derivatives biologically produced using the fatty acid biosynthetic pathway, have not been produced from renewable sources and, as such, are new compositions of matter. These new bioproducts can be distinguished from organic compounds derived from petrochemical carbon on the basis of dual carbon-isotopic fingerprinting or $^{14}C$ dating. Additionally, the specific source of biosourced carbon (e.g., glucose vs. glycerol) can be determined by dual carbon-isotopic fingerprinting (see, e.g., U.S. Pat. No. 7,169,588, which is herein incorporated by reference).

The ability to distinguish bioproducts from petroleum-based organic compounds is beneficial in tracking these materials in commerce. For example, organic compounds or chemicals comprising both biologically-based and petroleum-based carbon isotope profiles may be distinguished from organic compounds and chemicals made only of petroleum-based materials. Hence, the instant materials may be followed in commerce on the basis of their unique carbon isotope profile.

Bioproducts can be distinguished from petroleum-based organic compounds by comparing the stable carbon isotope ratio ($^{13}C/^{12}C$) in each fuel. The $^{13}C/^{12}C$ ratio in a given bioproduct is a consequence of the $^{13}C/^{12}C$ ratio in atmospheric carbon dioxide at the time the carbon dioxide is fixed. It also reflects the precise metabolic pathway. Regional variations also occur. Petroleum, $C_3$ plants (the broadleaf), $C_4$ plants (the grasses), and marine carbonates all show significant differences in $^{13}C/^{12}C$ and the corresponding $\delta^{13}C$ values. Furthermore, lipid matter of $C_3$ and $C_4$ plants analyze differently than materials derived from the carbohydrate components of the same plants as a consequence of the metabolic pathway.

Within the precision of measurement, $^{13}C$ shows large variations due to isotopic fractionation effects, the most significant of which for bioproducts is the photosynthetic mechanism. The major cause of differences in the carbon isotope ratio in plants is closely associated with differences in the pathway of photosynthetic carbon metabolism in the plants, particularly the reaction occurring during the primary carboxylation (i.e., the initial fixation of atmospheric $CO_2$). Two large classes of vegetation are those that incorporate the "$C_3$" (or Calvin-Benson) photosynthetic cycle and those that incorporate the "$C_4$" (or Hatch-Slack) photosynthetic cycle.

In $C_3$ plants, the primary $CO_2$ fixation or carboxylation reaction involves the enzyme ribulose-1,5-diphosphate carboxylase, and the first stable product is a 3-carbon compound. $C_3$ plants, such as hardwoods and conifers, are dominant in the temperate climate zones.

In $C_4$ plants, an additional carboxylation reaction involving another enzyme, phosphoenol-pyruvate carboxylase, is the primary carboxylation reaction. The first stable carbon compound is a 4-carbon acid that is subsequently decarboxylated. The $CO_2$ thus released is refixed by the $C_3$ cycle. Examples of $C_4$ plants are tropical grasses, corn, and sugar cane.

Both $C_4$ and $C_3$ plants exhibit a range of $^{13}C/^{12}C$ isotopic ratios, but typical values are about −7 to about −13 per mil for $C_4$ plants and about −19 to about −27 per mil for $C_3$ plants (see, e.g., Stuiver et al., *Radiocarbon* 19:355, 1977). Coal and petroleum fall generally in this latter range. The $^{13}C$ measurement scale was originally defined by a zero set by Pee Dee Belemnite (PDB) limestone, where values are given in parts per thousand deviations from this material. The "$\delta^{13}C$" values are expressed in parts per thousand (per mil), abbreviated, ‰, and are calculated as follows:

$$\delta^{13}C(‰)=[(^{13}C/^{12}C)_{sample}-(^{13}C/^{12}C)_{standard}]/(^{13}C/^{12}C)_{standard}\times 1000$$

Since the PDB reference material (RM) has been exhausted, a series of alternative RMs have been developed in cooperation with the IAEA, USGS, NIST, and other selected international isotope laboratories. Notations for the per mil deviations from PDB is $\delta^{13}C$. Measurements are made on $CO_2$ by high precision stable ratio mass spectrometry (IRMS) on molecular ions of masses 44, 45, and 46.

The compositions described herein include bioproducts produced by any of the methods described herein. Specifically, the bioproduct can have a $\delta^{13}C$ of about −28 or greater, about −27 or greater, −20 or greater, −18 or greater, −15 or greater, −13 or greater, −10 or greater, or −8 or greater. For example, the bioproduct can have a $\delta^{13}C$ of about −30 to about −15, about −27 to about −19, about −25 to about −21, about −15 to about −5, about −13 to about −7, or about −13 to about −10. In other instances, the bioproduct can have a $\delta^{13}C$ of about −10, −11, −12, or −12.3.

Bioproducts can also be distinguished from petroleum-based organic compounds by comparing the amount of $^{14}C$ in each compound. Because $^{14}C$ has a nuclear half life of 5730 years, petroleum-based fuels containing "older" carbon can be distinguished from bioproducts which contain "newer" carbon (see, e.g., Currie, "Source Apportionment of Atmospheric Particles", *Characterization of Environmental Particles*, J. Buffle and H. P. van Leeuwen, Eds., 1 of Vol. I of the IUPAC Environmental Analytical Chemistry Series (Lewis Publishers, Inc) (1992) 3-74).

The basic assumption in radiocarbon dating is that the constancy of $^{14}C$ concentration in the atmosphere leads to the constancy of $^{14}C$ in living organisms. However, because of atmospheric nuclear testing since 1950 and the burning of fossil fuel since 1850, $^{14}C$ has acquired a second, geochemical time characteristic. Its concentration in atmospheric $CO_2$, and hence in the living biosphere, about doubled at the peak of nuclear testing, in the mid-1960s. It has since been gradually returning to the steady-state cosmogenic (atmospheric) baseline isotope rate ($^{14}C/^{12}C$) of about $1.2\times10^{-12}$, with an approximate relaxation "half-life" of 7-10 years. (This latter half-life must not be taken literally; rather, one must use the detailed atmospheric nuclear input/decay function to trace the variation of atmospheric and biospheric $^{14}C$ since the onset of the nuclear age.)

It is this latter biospheric $^{14}C$ time characteristic that holds out the promise of annual dating of recent biospheric carbon. $^{14}C$ can be measured by accelerator mass spectrometry (AMS), with results given in units of "fraction of modern carbon" ($f_M$). $f_M$ is defined by National Institute of Standards and Technology (NIST) Standard Reference Materials (SRMs) 4990B and 4990C. As used herein, "fraction of modern carbon" or "$f_M$" has the same meaning as defined by National Institute of Standards and Technology (NIST) Standard Reference Materials (SRMs) 4990B and 4990C, known as oxalic acids standards HOxI and HOxII, respectively. The fundamental definition relates to 0.95 times the $^{14}C/^{12}C$ C isotope ratio HOxI (referenced to AD 1950). This is roughly equivalent to decay-corrected pre-Industrial Revolution wood. For the current living biosphere (plant material), $f_M$ is about 1.1.

The invention provides a bioproduct comprising a fatty acid and/or a fatty acid derivative produced according to the methods herein, which can have an $f_M{}^{14}C$ of at least about 1. For example, the bioproduct can have an $f_M{}^{14}C$ of at least about 1.01, an $f_M{}^{14}C$ of about 1 to about 1.5, an $f_M{}^{14}C$ of about 1.04 to about 1.18, or an $f_M{}^{14}C$ of about 1.111 to about 1.124.

Another measurement of $^{14}C$ is known as the percent of modern carbon, pMC. For an archaeologist or geologist using $^{14}C$ dates, AD 1950 equals "zero years old". This also represents 100 pMC. "Bomb carbon" in the atmosphere reached almost twice the normal level in 1963 at the peak of thermonuclear weapons. Its distribution within the atmosphere has been approximated since its appearance, showing values that are greater than 100 pMC for plants and animals living since AD 1950. It has gradually decreased over time with today's value being near 107.5 pMC. This means that a fresh biomass material, such as corn, would give a $^{14}C$ signature near 107.5 pMC. Petroleum-based compounds will have a pMC value of zero. Combining fossil carbon with present day carbon will result in a dilution of the present day pMC content. By presuming 107.5 pMC represents the $^{14}C$ content of present day biomass materials and 0 pMC represents the $^{14}C$ content of petroleum-based products, the measured pMC value for that material will reflect the proportions of the two component types. For example, a material derived 100% from present day soybeans would give a radiocarbon signature near 107.5 pMC. If that material was diluted 50% with petroleum-based products, it would give a radiocarbon signature of about 54 pMC.

A biologically-based carbon content is derived by assigning "100%" equal to 107.5 pMC and "0%" equal to 0 pMC. For example, a sample measuring 99 pMC will give an equivalent biologically based carbon content of 93%. This value is referred to as the mean biologically based carbon result and assumes all the components within the analyzed material originated either from present day biological material or petroleum-based material.

A bioproduct comprising a fatty acid and/or fatty acid derivative produced in accordance with the methods described herein can have a pMC of at least about 50, 60, 70, 75, 80, 85, 90, 95, 96, 97, 98, 99, or 100. In other instances, a fatty acid and/or fatty acid derivative described herein can have a pMC of between about 50 and about 100; about 60 and about 100; about 70 and about 100; about 80 and about 100; about 85 and about 100; about 87 and about 98; or about 90 and about 95. In yet other instances, a bioproduct comprising a fatty acid and/or fatty acid derivative can have a pMC of about 90, 91, 92, 93, 94, or 94.2.

For example, the fatty acids and/or derivatives thereof produced by the methods described herein can be used as biofuels. For example, the fatty acids and/or derivatives thereof as described herein can be used solely or as a component of biodiesel. The fatty acids and/or derivatives thereof produced according to the methods herein can also be used as, or as components or feedstocks of, various industrial chemicals, including without limitation, fuel additives. The resulting biofuel or industrial chemicals are bioproducts and will therefore have a $\delta^{13}C$ of about $-28$ or greater, about $-27$ or greater, $-20$ or greater, $-18$ or greater, $-15$ or greater, $-13$ or greater, $-10$ or greater, or $-8$ or greater. For example, the bioproduct can have a $\delta^{13}C$ of about $-30$ to about $-15$, about $-27$ to about $-19$, about $-25$ to about $-21$, about $-15$ to about $-5$, about $-13$ to about $-7$, or about $-13$ to about $-10$. Moreover, the resulting biofuel or industrial chemicals will have an $f_M{}^{14}C$ of at least about 1. For example, the bioproduct can have an $f_M{}^{14}C$ of at least about 1.01, an $f_M{}^{14}C$ of about 1 to about 1.5, an $f_M{}^{14}C$ of about 1.04 to about 1.18, or an $f_M{}^{14}C$ of about 1.111 to about 1.124.

Fuel Compositions

The fatty acids and/or derivatives thereof produced according to the methods and compositions herein possess various advantageous characteristics for use as a fuel. One of ordinary skill in the art will appreciate that, depending upon the intended purpose of the fuel, different fatty acids and/or derivatives thereof may have advantages as compared to others fatty acids and/or derivatives. For example, branched fatty acids and/or derivatives thereof may be more desirable as automobile fuels or components of automobile fuels that are intended for uses in cold climates. Similarly, for certain applications, it may be advantageous to produce a fuel that is either more or less oxygenated or more or less saturated.

Using the methods described herein, fuels comprising relatively homogeneous fatty acids and/or derivatives thereof that, at the same time, have the desired characteristics and qualities can be produced. Such fatty acid- and/or fatty acid derivative-based fuels can be characterized by carbon fingerprinting, and their lack of impurities, when compared to petroleum-derived fuels or biodiesel derived from triglyceride, is also advantageous. The fatty acid- and/or fatty acid derivative-based fuels can be combined with other fuels or fuel additives to produce alternative fuel compositions that have the desired properties.

The production hosts and methods disclosed herein can be used to produce free fatty acids and/or various fatty acid derivatives. In some embodiments, the production hosts and methods disclosed herein can be used to produce a higher and/or improved titer or yield of free fatty acids and/or fatty acid derivatives, including, for example, fatty esters. In some embodiments, the percentage of free fatty acids in the product produced by the production host is at least about 1%, for example, at least about 2%, 3%, 4%, 5%, 6%, 7%, 8%, 9%, 10%, 15%, 20%, or 25%. In some embodiments, the percentage of fatty acid derivatives in the product produced by the production host is at least about 50%, for example, at least about 55%, 60%, 65%, 70%, 75%, 80%, 85%, or 90%. In some embodiments, the ratio of fatty acid derivative to free fatty acids in the product produced by the production host is about 10:1, 9:1, 8:1, 7:1, 5:1, 2:1, or 1:1.

In certain embodiments, the fatty acid derivative produced by the production host is a fatty acid ethyl derivative. An exemplary fatty acid ethyl derivative is a fatty ethyl ester. In particular embodiments, the fatty ethyl ester is an ethyl dodecanoate, ethyl tridecanoate, ethyl tetradecanoate, ethyl pentadecanoate, ethyl cis-9-hexadecenoate, ethyl hexadecanoate, ethyl heptadecanoate, ethyl cis-11-octadecenoate, or ethyl octadecanoate ester. In particular embodiments, the fatty acid derivative product that is produced by the production host is a combination of a variety of fatty acid derivatives. For example, the fatty acid derivative product comprises a mixture of any combination of an ethyl dodecanoate, ethyl tridecanoate, ethyl tetradecanoate, ethyl pentadecanoate, ethyl cis-9-hexadecenoate, ethyl hexadecanoate, ethyl heptadecanoate, ethyl cis-11-octadecenoate, and ethyl octadecanoate ester. In certain other embodiment, the fatty acid derivative produced is a fatty methyl derivative. An exemplary fatty methyl derivative if s fatty methyl ester. In particular embodiments, the fatty methyl ester produced by the production host is a methyl dedecanoate, methyl tridecanoate, methyl tetradecanoate, methyl pentadecanoate, methyl cis-9- hexadecenoate, methyl hexadecanoate, methyl heptadecanoate, methyl cis-11-octadecenoate, or methyl octadecanoate. In certain embodiments, the fatty acid derivative product produced by the production host is a combination of a variety of fatty acid derivative products. For example, the fatty acid derivative is a mixture of one or more of methyl dedecanoate, methyl tridecanoate, methyl tetradecanoate, methyl pentadecanoate, methyl cis-9-hexadecenoate, methyl hexadecanoate, methyl heptadecanoate, methyl cis-11-octadecenoate, and methyl octadecanoate. In certain other embodiments, the fatty acid derivative is a mixture of one or more fatty methyl esters and one or more fatty ethyl esters. In certain embodiments, the product is a mixture of one or more free fatty acids, and/or one or more fatty acid derivatives. In yet further embodiments, the product is a mixture of one or more free fatty acids, and/or one or more fatty methyl esters, and/or one or more fatty ethyl esters.

The production hosts and methods disclosed herein can be used to produce different proportions of free fatty acids and fatty acid derivatives. In some embodiments, the proportion of free fatty acids in the product can be modified according to the methods, compositions, vectors and cells described herein such that the proportion is higher or lower vs. the fatty acid derivatives that are produced. In certain related embodiments, the proportion of fatty acid derivatives in the product can also be modified according to the disclosures herein, such that the proportion is higher or lower vs. the other products, for example, the free fatty acids, that are produced. In certain other embodiments, the proportional yield of fatty acid derivative with certain carbon chain lengths can be increased or decreased.

The terms "proportional yield," as used herein, refers to the amount of a desired product in relation to other products that are within the same mixture produced by a recombinant host of the present invention. For example, the proportional yield of a desired product can be improved such that it is more predominant over the other components in the product mixture to reduce the burden of purification. In another example, the proportional yield of an undesired product (i.e., a component that will need to be removed from the desired product) can be reduced such that it is less predominant over the desired component in the product mixture to achieve the same end.

Carbon Fingerprinting

Biologically produced fatty acid derivatives can provide a new source of fuels, such as alcohols, diesel, and gasoline. Biofuels made according to the methods and compositions described herein have not heretofore been produced from renewable sources and are new compositions of matter. These new fuels can be distinguished from fuels derived from petrochemical carbon on the basis of dual carbon-isotopic fingerprinting. Additionally, the specific source of biosourced carbon (e.g., glucose vs. glycerol) can be determined by dual carbon-isotopic fingerprinting (see U.S. Pat. No. 7,169,588, which is herein incorporated by reference in its entirety, in particular, at col. 4, line 31, to col. 6, line 8).

The fatty acids and/or fatty acid derivatives and the associated biofuels, chemicals, and mixtures can be distinguished from their petrochemical derived counterparts on the basis of $^{14}C$ ($f_M$) and dual carbon-isotopic fingerprinting.

The fatty acids and/or derivatives thereof as described herein have utility in the production of biofuels and chemicals. The products provided by the instant invention can be distinguished on the basis of dual carbon-isotopic fingerprinting from those materials derived solely from petrochemical sources. The ability to distinguish these products is beneficial in tracking these materials in commerce. For example, fuels or chemicals comprising both "new" and "old" carbon isotope profiles can be distinguished from fuels and chemicals made only of "old" materials. Thus, the instant materials can be followed or "tracked" in commerce or identified in commerce as a biofuel on the basis of their unique profile. In addition, other competing materials can be identified as being biologically derived or derived from a petrochemical source.

In some examples, a biofuel composition is made, which includes a fatty acid derivative having $\delta^{13}C$ of from about −10.9 to about −15.4, wherein the fatty acid derivative accounts for at least about 85% of biosourced material (i.e., derived from a renewable resource such as, for example, cellulosic materials and sugars) in the composition. In other examples, the biofuel composition includes a fatty acid derivative having the formula:

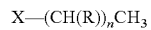

wherein

X=$CH_3$, —$CH_2OR^1$; —$C(O)OR^2$; or —$C(O)NR^3R^4$;

R=for each n, independently absent, an H, or a lower aliphatic;

n=an integer from about 8 to about 34, preferably an integer from about 10 to about 24;

$R^1$, $R^2$, $R^3$, $R^4$=independently selected from an H or a lower alkyl.

Typically, when R is a lower aliphatic group, R represents a branched, unbranched or cyclic lower alkyl or lower alkenyl moiety. Exemplary R groups include, without limitation, methyl, isopropyl, isobutyl, sec-butyl, cyclopentenyl, and the like. The fatty acid derivative is additionally characterized as having a $\delta^{13}C$ of from about −10.9 to about −15.4, and the fatty acid derivative accounts for at least about 85% of biosourced material in the composition. In some examples the fatty acid derivative in the biofuel composition is characterized by having a fraction of modern carbon ($f_m$ $^{14}C$) of at least about 1.003, 1.010, or 1.5.

Impurities

The fatty acids and/or derivatives thereof produced in accordance with the disclosures herein are useful as components or feedstocks for making biofuels as well as other industrial chemicals. These products are made directly from suitable substrates and not from the chemical processing of triglycerides. Accordingly, fuels and other industrial chemicals comprising the disclosed fatty acids and/or derivatives often contain fewer impurities than are normally associated with, for example, products derived from triglycerides such as fuels derived from vegetable oils and fats.

The crude biofuels prepared in accordance with the disclosures herein (prior to mixing the fatty acids and/or derivatives with other fuels such as petroleum-based fuels) contain less transesterification catalysts than petroleum-based diesel or other biodiesel produced via one or more transesterification steps. The biofuel can contain less than about 2.0 wt. %, for example, less than about 1.5, 1.0, 0.5, 0.3, 0.1, 0.05, or 0 wt. % of a transesterification catalyst or an impurity resulting from a transesterification catalyst. Examples of transesterification catalysts include, without limitation, hydroxide catalysts, such as NaOH, KOH, and LiOH; and acidic catalysts, such as mineral acid catalysts and Lewis acid catalysts. Non-limiting examples of catalysts and impurities resulting from transesterification catalysts include tin, lead, mercury, cadmium, zinc, titanium, zirconium, hafnium, boron, aluminum, phosphorus, arsenic, antimony, bismuth, calcium, magnesium, strontium, uranium, potassium, sodium, and lithium.

The biofuels prepared in accordance with the disclosures herein (prior to mixing the fatty acids and/or fatty acid derivatives with one or more other fuels) tend to have a low gelling point, especially when the fatty acid and/or fatty acid derivative product comprises a $C_{16:1}$ ethyl ester or a $C_{18:1}$ ethyl ester, as compared to the gelling points of other types of biofuels.

Similarly, the crude biofuels prepared in accordance with the disclosures herein contain less glycerol (or glycerin) than biofuels made from triglycerides. The biofuels can contain less than about 2.0 wt. %, for example, less than about 1.5, 1.0, 0.5, 0.3, 0.1, 0.05, or 0 wt. % of glycerol.

Crude biofuels herein also contain less free alcohol(s) (e.g., alcohols that are used to create the ester) than biodiesels made from triglycerides. This is due in part to the efficiency of utilization of the alcohols by the production hosts of the present disclosure. For example, the biofuels can contain less than about 2.0, 1.5, 1.0, 0.5, 0.3, 0.1, 0.05, or 0 wt. % of free alcohol.

The biofuels herein can be additionally characterized by its low concentration of sulfur as compared to petroleum-derived diesel. For example, the biofuel can have less than about 2.0 wt. %, for example, less than about 1.5, 1.0, 0.5, 0.3, 0.1, 0.05, or 0 wt. % of sulfur.

Additives and Fuel Compositions

Fuel additives are used to enhance the performance of a fuel or engine. For example, fuel additives can be used to alter the freezing/gelling points, cloud points, lubricity, viscosity, oxidative stability, ignition quality, octane levels, and flash points. In the United States, all fuel additives must be registered with Environmental Protection Agency. The names of fuel additives and the companies that sell the fuel additives are publicly available by contacting the EPA or by viewing the agency's website. One of ordinary skill in the art will appreciate that the fatty acids and/or fatty acid derivatives described herein can be mixed with one or more fuel additives to impart a desired quality.

The fatty acids and/or derivatives thereof described herein can be formulated or processed into suitable fuel additives, which enhance the performance of fuels or engines. For example, the fatty acids and/or derivatives described herein can be formulated into lubricity improvers, which impart desirable properties such as wear protection to the engine parts. Accordingly, additive compositions comprising the fatty acids and/or derivatives thereof produced in accordance with the disclosures herein are provided. In another example, the fatty acids and/or fatty acid derivatives described herein can be formulated into corrosion inhibitors.

The fatty acids and/or fatty acid derivatives described herein can be mixed with other fuels such as one or more biodiesels derived from triglycerides, various alcohols such as ethanol and butanol, and petroleum-derived products such as gasoline or diesel. Under certain circumstances, a fatty acid and/or fatty acid derivative with a low gelling point, such as a $C_{16:1}$ ethyl ester or a $C_{18:1}$ ethyl ester, is produced. This low gelling point product can be mixed with one or more biodiesels made from triglycerides to reduce gelling point of the resulting fuel when compared to a fuel containing only the one or more biodiesels made from triglycerides. Similarly, a fatty acid derivative, such as a $C_{16:1}$ ethyl ester or a $C_{18:1}$ ethyl ester, can be mixed with a petroleum-derived diesel to provide a mixture that contains at least about, and often greater than about, 5% by weight of biodiesel. In some examples, the fuel mixture includes at least about 10%, 15%, 20%, 30%, 40%, 50%, and 60% by weight of the fatty acid derivative.

In some embodiments, the fuel composition can further comprise a synthetic fuel. Any synthetic fuel obtained from coal, natural gas, or biomass can be suitably used. In a further embodiments, the synthetic fuel comprises a Fischer-Tropsch based fuel, a Bergius-based fuel, a Mobil-based fuel, a Karrick-based fuel, or a combination thereof. In still further embodiments, the synthetic fuel comprises a Coal-To-Liquids based fuel (CTL-based fuel), a Gas-To-Liquids based fuel (GTL-based fuel), a Biomass-To-Liquids based fuel (BTL-based fuel), a Coal and Biomass-To-Liquids based fuel (CBTL-based fuel), or a combination thereof. In an exemplary embodiment, the synthetic fuel comprises a Fischer-Tropsch-based fuel.

The amount of synthetic fuel in the fuel composition disclosed herein may be from about 5% to about 90%, from about 5% to about 80%, from about 5% to about 70%, from about 5% to about 60%, or from about 5% to about 50%.

In certain embodiments, a biofuel composition can be made that includes at least about 5%, 10%, 20%, 30%, 40%, 50%, 60%, 70%, 80%, 85%, 90% or 95% of a fatty acid derivative that includes a carbon chain that is 8:0, 10:0, 12:0, 14:0, 14:1, 16:0, 16:1, 18:0, 18:1, 18:2, 18:3, 20:0, 20:1, 20:2, 20:3, 22:0, 22:1 or 22:3. Such biofuel compositions can additionally include at least one additive selected from a cloud point lowering additive that can lower the cloud point to less than about 5° C., or less than about 0° C.; a surfactant; a microemulsion; at least about 5%, 10%, 15%, 20%, 30%, 40%, 50%, 60%, 70%, 80%, 85%, 90%, or 95% diesel fuel from triglycerides; a petroleum-derived gasoline; or a diesel fuel from petroleum.

In some embodiments, the fuel composition comprising fatty acids and/or derivatives thereof such as fatty esters produced in accordance with the methods, vectors, cells and compositions herein further comprises one or more diesel fuel additives. Suitable additives are desirably those that afford improved performance but also compatibility with the components in the fuel composition and devices that are typically associated with diesel engines. Examples of other suitable fuel additives include ignition improvers or cetane number improvers, detergents, dispersants, antiwear agents, viscosity index modifiers, friction modifiers, lubricity improvers, stabilizers, antioxidants, corrosion inhibitors, biocides, metal deactivators, and minor amounts of other optional additives, including, without limitation, antifoaming agents and seal fixes.

In particular embodiments, ignition improvers or cetane number improvers are often added to improve diesel engine performance. Exemplary cetane number improvers include 2'-ethylhexyl nitrate, and other alkyl nitrates. Cetane number improvers can be added to a fuel composition in an amount that is about 0.01 wt. % to about 1.0 wt. %, e.g., about 0.05 wt. % to about 0.5 wt. %, based on the total weight of the fuel composition.

In certain embodiments, various detergents and/or dispersants can be included in the fuel composition comprising the fatty acids and/or fatty acid derivatives produced in accordance with the present disclosures to associate and disperse or remove harmful deposits from diesel engine parts. Suitable detergents typically comprise a polar head comprising a metal salt of an acidic organic compound and a long hydrophobic tail. Exemplary detergents include borated carbonate salts, borated sulfonate salts, which are preferably overbased. See, e.g., U.S. Pat. Nos. 4,744,920, 4,965,003, the disclosures of which are incorporated herein. Exemplary dispersants include, without limitation, carboxylic dispersants, succinimide dispersants, amine dispersants, and Mannich dispersants. See, e.g., U.S. Pat. Nos. 3,172,892, 3,438,757, 3,980,569, and 6,165,235, the disclosures of which are incorporated by reference herein. Dispersants can be present in the fuel composition in an amount of about 0.01 wt. % to about 0.1 wt. %, e.g., 0.03 to about 0.05 wt. %, based on the total weight of the fuel composition.

In certain embodiments, antiwear agents, including for example, dihydrocarbyl dithiophosphate metal salts, can be added to the fuel composition to provide both antiwear and antioxidation benefits. See, e.g., U.S. Pat. No. 5,898,023, the disclosures of which are incorporated herein by reference.

In particular embodiments, the amount of lubricity improver in the fuel composition can range from about 1 ppm to about 50,000 ppm, for example, about 10 ppm to about 20,000 ppm, or about 25 ppm to about 10,000 ppm. Non-limiting examples of lubricity improvers include esters and fatty acids, which may or may not be the same as those produced in accordance to the methods described herein.

In particular embodiments, the amount of stabilizers, which improves the storage stability of the fuel composition, can range from about 0.001 wt. % to about 2 wt. %, e.g., about 0.01 wt. % to about 1 wt. %, based on the total weight of the fuel composition. An exemplary stabilizer is a tertiary alkyl primary amine Antioxidants prevent the formation of gum depositions on fuel system components due to oxidation of the fuels in storage and/or inhibit the formation of peroxide compounds in fuel compositions. The amount of antioxidants can range from about 0.001 wt. % to about 5 wt. %, e.g., from about 0.01 wt. % to about 1 wt. %, based on the total weight of the fuel composition.

Corrosion inhibitors protect ferrous metals in fuel handling systems, such as pipelines and storage tanks, from corrosion. Certain corrosion inhibitors are also known to impart additional lubricity, and as such are particularly suitable when additional lubricity is desired. The corrosion inhibitor may be present in the fuel composition in an amount of about 0.001 wt. % to about 5 wt. %, e.g., from about 0.01 wt. % to about 1 wt. %, based on the total weight of the fuel composition.

Biocides are used to combat microbial growth in the fuel composition, which may be present in the fuel composition at a concentration of about 0.001 wt. % to about 5 wt. %, e.g., from about 0.01 wt. % to about 1 wt. %, based on the total weight of the fuel composition.

Metal deactivators suppress the catalytic effects of some metals, particularly copper, have on fuel oxidation, which can be present in the fuel composition in an amount of about 0.001 wt. % to about 5 wt. %, e.g., at 0.01 wt. % to about 1 wt. %, based on the total weight of the fuel composition.

In addition, viscosity improvers, which are typically polymeric materials of number average molecular weights of from about 5,000 to about 250,000, and friction modifiers, which are typically sulfur-containing organo-molybdenum compounds can be added in minor amounts. Foam inhibitors, which typically include alkyl methacrylate polymers or dimethyl silicon polymers, can also be added to the fuel composition in an amount of less than about 10 ppm. Furthermore, seal fixes can be added to insure proper elastomer sealing and prevent premature seal failure can be included in the fuel composition.

The invention is further illustrated by the following examples. The examples are provided for illustrative purposes only. They are not to be construed as limiting the scope or content of the invention in any way.

EXAMPLES

Example 1

This example describes the construction of a genetically engineered microorganism wherein the expression of a fatty acid degradation enzyme is attenuated.

The fadE gene of *E. coli* MG1655 (an *E. coli* K strain) was deleted using the Lambda Red (also known as the Red-Driven Integration) system described by Datsenko et al., *Proc. Natl. Acad. Sci. USA* 97: 6640-6645 (2000), with the following modifications:

The following two primers were used to create the deletion of fadE:

```
Del-fadE-F
                                        (SEQ ID NO: 1)
5'-AAAAACAGCAACAATGTGAGCTTTGTTGTAATTATATTGTAA ACATATTGATTCCGGGGATCCGTCGACC;
and Del-fadE-R
                                        (SEQ ID NO: 2)
5'-AAACGGAGCCTTTCGGCTCCGTTATTCATTTACGCGGCTTCA

ACTTTCCTGTAGGCTGGAGCTGCTTC
```

The Del-fadE-F and Del-fadE-R primers were used to amplify the kanamycin resistance ($Km^R$) cassette from plasmid pKD13 (described by Datsenko et al., supra) by PCR. The PCR product was then used to transform electrocompetent *E. coli* MG1655 cells containing pKD46 (described in Datsenko et al., supra) that had been previously induced with arabinose for 3-4 hours. Following a 3-hour outgrowth in a super optimal broth with catabolite repression (SOC) medium at 37° C., the cells were plated on Luria agar plates containing 50 μg/mL of Kanamycin. Resistant colonies were identified and isolated after an overnight incubation at 37° C. Disruption of the fadE gene was confirmed by PCR amplification using primers fadE-L2 and fadE-R1, which were designed to flank the *E. coli* fadE gene.

The fadE deletion confirmation primers were:

```
fadE-L2 5'-CGGGCAGGTGCTATGACCAGGAC;   (SEQ ID NO: 3)
and fadE-R1 5'-CGCGGCGTTGACCGGCAGCCTGG   (SEQ ID NO: 4)
```

After the fadE deletion was confirmed, a single colony was used to remove the $Km^R$ marker using the pCP20 plasmid as described by Datsenko et al., supra. The resulting MG1655 *E. coli* strain with the fadE gene deleted and the $Km^R$ marker removed was named *E. coli* MG1655 ΔfadE, or *E. coli* MG 1655 D1.

Example 2

This example describes the construction of a genetically engineered microorganism in which the expression of a fatty acid degradation enzyme and an outer membrane protein receptor are attenuated.

The fhuA (also known as the tonA) gene of *E. coli* MG1655, which encodes a ferrichrome outer membrane transporter (GenBank Accession No. NP_414692), was deleted from strain *E. coli* MG1655 D1 of Example 1, using the Lambda Red system according to Datsenko et al., supra, but with the following modifications:

The primers used to create the deletion:

```
Del-fhuA-F
                                        (SEQ ID NO: 5)
5'-ATCATTCTCGTTTACGTTATCATTCACTTTACATCAGAGA

TATACCAATGATTCCGGGGATCCGTCGACC;
```

-continued and

```
Del-fhuA-R
                                           (SEQ ID NO: 6)
5'-GCACGGAAATCCGTGCCCCAAAAGAGAAATTAGAAACGGA

AGGTTGCGG TTGTAGGCTGGAGCTGCTTC
```

The Del-fhuA-F and Del-fhuA-R primers were used to amplify the kanamycin resistance (Km$^R$) cassette from plasmid pKD13 by PCR. The PCR product obtained was used to transform electrocompetent *E. coli* MG1655 D1 cells containing pKD46 (see Example 1). These cells had been previously induced with arabinose for about 3-4 h. Following a 3-h outgrowth in SOC medium at 37° C., the cells were plated on Luria agar plates containing 50 μg/mL of kanamycin. Resistant colonies were identified and isolated after an overnight incubation at 37° C. Disruption of the fhuA gene was confirmed in some of the colonies by PCR amplification using primers flanking the *E. coli* fhuA gene:

Confirmation of the deletion was performed using the following primers:

```
fhuA-verF 5'-CAACAGCAACCTGCTCAGCAA;   (SEQ ID NO: 7)
and fhuA-verR 5'-AAGCTGGAGCAGCAAAGCGTT   (SEQ ID NO: 8)
```

After the fhuA deletion was confirmed, a single colony was used to remove the Km$^R$ marker using the pCP20 plasmid as described by Datsenko et al., supra. The resultant MG1655 *E. coli* strain having fadE and fhuA gene deletions was named *E. coli* MG1655 ΔfadE_ΔfhuA, or *E. coli* MG1655 DV2.

Example 3

This example describes the construction of a genetically engineered microorganism in which the expression of an acyl-CoA dehydrogenase, an outer membrane protein receptor, a pyruvate formate lyase and a lactate dehydrogenase are attenuated.

The pflβ gene of *E. coli* MG1655, which encodes a pyruvate formate lyase (GenBank Accession No. AAC73989) was deleted from *E. coli* MG1655 DV2 (see, Example 2) using the Lamda Red System according to Datsenko et al., supra, but with the following modifications:

The primers used to create the deletion strain were:

```
Del-pflB-F:
                                           (SEQ ID NO: 9)
5'-GCCGCAGCCTGATGGACAAAGCGTTCATTATGGTGCTGCCGGTC

GCGATGATTCCGGGGATCCGTCGACC

Del-pflB-R:
                                           (SEQ ID NO: 10)
5'-ATCTTCAACGGTAACTTCTTTACCGCCATGCGTGTCCCAGGTGT

CTGTAGGCTGGAGCTGCTTCG
```

The Del-pflB-F and Del-pflB-R primers were used to amplify the kanamycin resistance (Km$^R$) cassette from plasmid pKD13 by PCR. The PCR product was then used to transform electrocompetent *E. coli* MG1655 DV2 cells (see Example 2).

In parallel, the ldhA gene of *E. coli* MG1655, which encodes a lactate dehydrogenase, specifically an NAD-linked fermentative D-lactate dehydrogenase (see, e.g., Mat-Jan et al., *J. Bacteriol.* 171(1):342-8 (1989); Bunch et al., *Microbiol.* 143(1):187-95 (1997) (GenBank Accession No. AAC74462) was also deleted from *E. coli* MG1655 DV2 (see, Example 2) using the Lambda Red System according to Datsenko et al., supra, but with the following modifications.

Two primers were used to create the deletion:

```
Del-ldhA-F:
                                           (SEQ ID NO: 11)
5'-CTCCCCTGGAATGCAGGGGAGCGGCAAGATTAAACCAGTTCGTTC

GGGCAGTGTAGGCTGGAGCTGCTTCG-3'

Del-ldhA-R:
                                           (SEQ ID NO: 12)
5'-TATTTTTAGTAGCTTAAATGTGATTCAACATCACTGGAGAAAGTC

TTATGCATATGAATATCCTCCTTAGTTCC-3'
```

The Del-ldhA-F and Del-ldhA-R primers were used to amplify the chloramphenicol acetyltransferase resistance (Cm$^R$) cassette from plasmid pKD3 (see, Datsenko et al., supra) by PCR. The PCR product was also used to transform electrocompetent *E. coli* MG1655 DV2 cells (see, Example 2).

The *E. coli* MG1655 DV2 (see Example 2) cells had been previously induced with arabinose for about 3-4 h. Following a 3-h outgrowth in SOC medium at 37° C., the cells were plated on Luria agar plates containing 50 μg/mL of kanamycin and 30 μg/mL chloroamphenicol. Colonies that were resistant to both kanamycin and chlroamphenicol were identified and isolated after an overnight incubation at 37° C. Disruption of the pflB gene was confirmed using primers flanking the *E. coli* pflB gene, and disruption of the ldhA gene was verified using primers flanking the *E. coli* ldhA gene.

Confirmation of the deletion of pflB was performed using the following primers:

```
pflB-verF:  5'-GGACTAAACGTCCTACAAAC (SEQ ID NO: 14)

PflB-verR:  5'-TTCATCTGTTTGAGATCGAG (SEQ ID NO: 15)
```

Confirmation of the deletion of ldhA gene was performed using the following primers:

```
ldhA-verF:
5'- CCCGAGCGGTAGCCAGATGCCCGCCAGCG   (SEQ ID NO:16)

ldhA-verR:
5'- GCTGCGGGTTAGCGCACATCATACGGGTC   (SEQ ID NO:17)
```

After the deletions were confirmed, a single colony was used to remove the Km$^R$ and Cm$^R$ markers in accordance with the method described by Datsenko et al., supra. The resultant MG1655 *E. coli* strain having fadE, fhuA, pflB and ldhA gene deletions was named *E. coli* MG1655 ΔfadE_ΔfhuA_Δpfl B_ΔldhA, or *E. coli* MG1655 DV4.

Example 4

This example describes the construction of a genetically engineered microorganism in which the expression of a fatty acid degradation enzyme such as an acyl-CoA synthase, an outer membrane protein receptor, and an acyl-CoA dehydrogenase are attenuated.

The fadD gene of *E. coli* MG1655 was deleted from strain *E. coli* MG1655 DV2 (see, Example 2), using the Lambda Red system described by Datsenko et al, supra, but with the following modifications:

The primers used to create the deletion of fadD were:

```
fad1:
                                        (SEQ ID NO: 19)
5'-TAACCGGCGTCTGACGACTGACTTAACGCTCAGGCTTTATT GTCCACTTTGTGTAGGCTGGAGCTGCTTCG-3';
and fad2:
                                        (SEQ ID NO: 20)
5'-ATTTGGGGTTGCGATGACGACGAACACGCATTTTAGAGGTG

AAGAATTGCATATGAATATCCTCCTTTAGTTCC-3'
```

The fad1 and fad2 primers were used to amplify the chloramphenicol acetyltransferase resistance (Cm$^R$) casette from plasmid pKD3 (described by Datsenko et al., supra) by PCR. The PCR product was used to transform electrocompetent *E. coli* MG1655 DV2 (see, Example 2). The transformed cells were plated on Luria agar plates containing 30 μg/mL of chloramphenicol and grown overnight at 37° C. Individual colonies were isolated, transferred to fresh Luria agar plates, and grown at 42° C. These colonies were then patched onto Luria agar plates containing 30 μg/mL of chloramphenicol and 100 μg/mL carbenicillin, and grown at 37° C. overnight. Colonies that were resistant to chloramphenicol and sensitive to carbenicillin were evaluated further by PCR to ensure that the PCR product inserted at the correct site. Specifically, disruption of the fadD gene was confirmed by PCR amplification using primers fadF and fadR, which were designed to flank the fadD gene:

```
fadF: 5'-CGTCCGTGGTAATCATTTGG-3';    (SEQ ID NO: 21)
and fadR: 5'-TCGCAACCTTTTCGTTGG-3'       (SEQ ID NO: 31)
```

After the fadD deletion was confirmed, the Cm$^R$ marker was removed using a FLP helper plasmid as described by Datsenko et al., supra. The resulting MG1655 *E. coli* strain was named *E. coli* MG1655 ΔfadEΔfhuAΔfadD, or *E. coli* MG1655 DV2 ΔfadD. The DV2 ΔfadD strain was unable to grow on M9+oleate agar plates (which supply oleate as carbon source). It was also unable to grow in M9+oleate liquid media.

Example 5

This example describes the construction of a bacterial expression plasmid, pDS33.ES9, (FIG. 3) in which expression of an ester synthase gene from *M. hydrocarbonoclasticus* DSM 8798 (GenBank Accession No. ABO21021) is under the control of the *E. coli* spc ribosomal protein operon promoter Pspc (SEQ ID NO:13, FIG. 4).

The Pspc promoter, as shown in FIG. 2, was amplified from *E. coli* MG1655 chromosomal DNA with the following primers:

```
PspcIFF
                                        (SEQ ID NO: 32)
5' - AAAGGATGTCGCAAACGCTGTTTCAGTACACTCTCTCAAT AC - 3';
and PspcIFR
                                        (SEQ ID NO: 33)
5' - GAGCTCGGATCCATGGTTTAGTGCTCCGCTAATG - 3'
```

All PCR reactions described in this example were performed with Phusion™ Polymerase (NEB, Ipswich, Mass.). The Pspc promoter PCR fragment was used to replace both the lacI$_q$ and Trc promoter regions of plasmid OP80 by cloning the PCR product into BseRI/NcoI restricted OP80 using the InFusion™ Cloning kit (Clontech, Palo Alto, Calif.). The resulting plasmid, named pDS22, still possessed a lacZ sequence downstream of the multiple cloning site. Next, the lacZ sequence was removed by PCR amplification of plasmid pDS22 using the following primers:

```
                                        (SEQ ID NO: 34)
pCLIlacDF    5' - GAATTCCACCCGCTGACGAGCTTAG - 3';
and (SEQ ID NO: 35)
pCLEcoR      5' - CGAATTCCCATATGGTACCAG - 3'
```

The PCR product was digested by EcoRI and self ligated to form pDS23. Plasmid pDS23 does not contain the lacI$_q$, lacZ, or Trc DNA.

An ester synthase from *M. hydrocarbonoclasticus* DSM 8798 (GenBank Accession No. ABO21021), referred to as ES9 herein, was synthesized by DNA2.0 (Menlo Park, Calif.). This synthesized ES9 ester synthase gene was subcloned into pColaDuet-1 to form plasmid pHZ1.97-ES9. The internal BspHI site in the ES9 ester synthase gene was removed by site directed mutagenesis using the QuikChange® Multi Kit (Stratagene, Carlsbad, Calif.) and the following mutagenic primer:

```
                                        (SEQ ID NO: 36)
ES9BspF     5' - CCCAGATCAGTTTTATGATTGCCTCGCTGG - 3'
```

This primer introduced a silent mutation into the ES9 ester synthase gene. The resulting plasmid, named pDS32, then was used as a template to amplify the ES9 ester synthase gene with the following primers:

```
                                        (SEQ ID NO: 37)
ES9BspHF    5' - ATCATGAAACGTCTCGGAAC - 3';
and (SEQ ID NO: 38)
ES9XhoR     5' - CCTCGAGTTACTTGCGGGTTCGGGCGCG - 3'
```

The resulting PCR product was subject to restriction digestions with BspHI and XhoI and ligated into plasmid pDS23 digested with NcoI and XhoI to form pDS33.ES9 (SEQ ID NO:22). The sequence of pDS33.ES9 is shown in FIG. 3 with the residues representing the Pspc promoter in italics and the residues of the ES9 ester synthase gene in bold type.

Example 6

This example describes the construction of a bacterial expression plasmid, pDS57 (SEQ ID NO:23) in which expression of an ester synthase gene is under the control of the Ptrc promoter.

The ES9 ester synthase gene was amplified from plasmid pDS33.ES9 (SEQ ID NO:22, Example 5) using primers ES9BspHF (SEQ ID NO:37) and ES9XhoR (SEQ ID NO:38).

The PCR product was digested with BspHI and XhoI and ligated into NcoI/XhoI restricted OP80 to form plasmid pDS57 (SEQ ID NO:23), wherein the ES9 ester synthase gene is under control of the Trc promoter. The sequence of pDS57 is shown in FIG. 4 with the Trc promoter in italics and the ES9 ester synthase gene in bold type.

Example 7

This example illustrates that expression of ester synthase alone, without co-expression of an acyl-CoA synthase or a thioesterase, can be used to produce fatty esters in vivo.

Seed cultures of *E. coli* MG1655 DV2 ΔfadD of Example 4, each carrying one of the following plasmids:
(1) a pCL plasmid containing no insert (negative control);
(2) a plasmid containing *E. coli* thioesterase 'tesA;
(3) a plasmid containing a polynucleotide encoding *Alcanivorax borkumensis* SK2 ester synthase atfA1 (GenBank Accession No. YP_694462);
(4) a plasmid containing a polynucleotide encoding *Alcanivorax borkumensis* SK2 ester synthase atfA2 (GenBank Accession No. YP_693524);
(5) a plasmid containing a polynucleotide encoding *Marinobacter hydrocarbonoclasticus* DSM 8798 ester synthase ES8 (GenBank Accession No. ABO21020); and
(6) a plasmid containing a polynucleotide encoding *Marinobacter hydrocarbonoclasticus* DSM 8798 ester synthase ES9 (GenBank Accession No. ABO21021)
were grown in 24-well plates in LB broth supplemented with 100 μg/mL spectinomycin. The ester synthase plasmids were constructed as described in Example 5 to generate plasmids pDS41. S (containing atfA1 gene), pDS31atfa2 (containing atfA2 gene), pDS31.ES8 (containing the gene encoding ES8), and pDS33.ES9 (containing the gene encoding ES9).

After 4-h of growth, the cultures were diluted 1:25 in Che-92N-BT (2% glucose, nitrogen limited medium, 0.2 M Bis-Tris, pH 7.0, 0.1% Triton) containing spectinomycin and grown overnight. The cultures were diluted in 4N-BT (4% glucose, nitrogen limited medium, 0.2M Bis-Tris, pH 7.0, 0.1% Triton) to a final OD600 (optical density at 600 nm) of about 0.2. After 6-h of growth, IPTG was added to a final concentration of 1 mM, along with either water or ethanol (2% (v/v)). At 22-h post-induction, 1 mL of culture was acidified with 200 μM HCl, and extracted with 500 μL ethyl acetate. The fatty acids and esters were then treated with the derivatizing agent TMAH and quantified by GC/FID. The amount of free fatty acid (FFA) and fatty acyl ethyl ester (FAEE) produced in each culture is shown in FIG. 5.

As shown in FIG. 5, ES9 generated nearly 200 mg/L FAEE in the presence of ethanol, but only a small quantity (<20%) of FFA. Compared to ester synthase ES9, the other ester synthases, including ES8, atfA1 and atfA2, produced substantially lower amounts of FAEE in the presence of ethanol, accompanied by a higher proportion of FFA. The culture *E. coli* 'tesA produced higher overall titers of FFA and FAEE in the presence of ethanol, but the amount of FFA was significantly greater than the amount of FAEE generated.

The results indicate that the expression of ester synthase in *E. coli* MG1655 DV2 ΔfadD leads to the production of esters in the presence of ethanol. In particular, expression of ester synthase ES9 resulted in the highest ester production in the presence of ethanol as compared to that of the other ester synthases. Furthermore, this example indicated that expression of 'TesA alone in *E. coli* MG1655 DV2 ΔfadD resulted in the production of a low level of esters and a high level of free fatty acids in the presence of ethanol.

Example 8

This example demonstrates that expression of an ester synthase alone, without co-expression of an acyl-CoA synthase or a thioesterase, can be used to produce esters in vivo in the presence of ethanol.

Seed cultures of *E. coli* MG1655 DV2 ΔfadD of Example 4, each carrying one of the following plasmids:
(1) a plasmid containing an *E. coli* 'tesA;
(2) a plasmid containing a polynucleotide encoding *Alcanivorax borkumensis* SK2 ester synthase atfA1 (GenBank Accession No. YP_694462);
(3) a plasmid containing a polynucleotide encoding *Alcanivorax borkumensis* SK2 ester synthase atfA2 (GenBank Accession No. YP_693524);
(4) a plasmid containing a polynucleotide encoding *Marinobacter hydrocarbonoclasticus* DSM 8798 ester synthase ES8 (GenBank Accession No. ABO21020); and
(5) a plasmid containing a polynucleotide encoding *Marinobacter hydrocarbonoclasticus* DSM 8798 ester synthase ES9 (GenBank Accession No. ABO21021)
were grown in shake flask cultures and induced with 1 mM IPTG and 2% (v/v) ethanol. At 24-h post induction, aliquots from each culture were extracted and analyzed using GC-FID for fatty acid and ester content. The amounts of free fatty acid (FFA) and fatty acyl ethyl ester (FAEE) produced in each culture were shown in FIG. 6.

Figure 6:
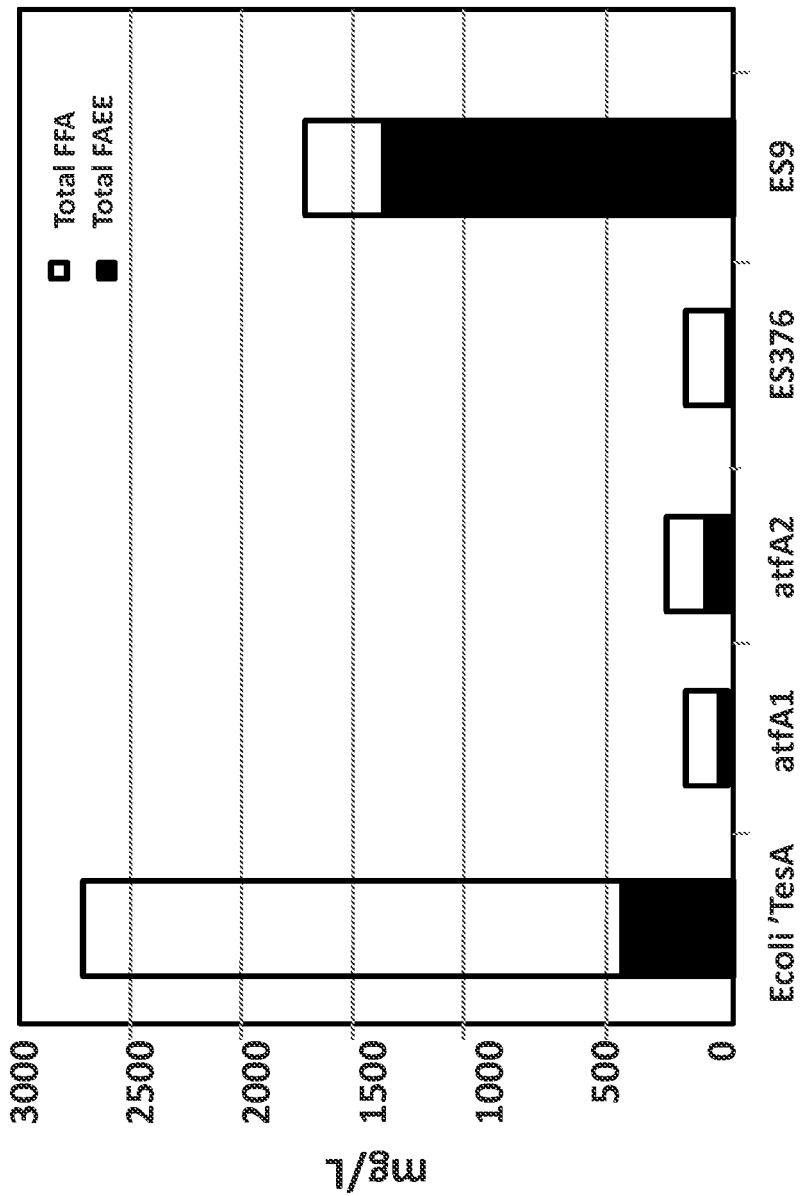
FIG. 6 depicts the production of FFA and/or FAEE in accordance with Example 7, without co-expression of acyl-CoA synthase or a thioesterase, but in the presence of ethanol in shake flasks. Ester synthases ES9, ES8, atfA1 and atfA2 were all able to produce FAEE in vivo under the prescribed conditions. ES9 generated a high level of FAEE in the presence of ethanol, but only little FFA was produced. Compared to ES9, noticeably smaller amounts of FAEE were produced by atfA1, atfA2, and ES8. Consistent with the results of Example 6 and FIG. 5, expression of E. coli 'tesA alone produced high overall titers of FFA and FAEE, but with a significantly higher proportion of FFA.

As shown in FIG. 6, ester synthase ES9 generated a high level of FAEE in the presence of ethanol, accompanied by a low level of FFA. Compared to ES9, noticeably smaller amounts of FAEE were produced by ester synthases atfA1, atfA2, and ester synthase ES8. Consistent with the results of Example 7 and FIG. 5, above, expression of *E. coli* 'tesA alone produced high overall titers of FFA and FAEE, but with a significantly higher proportion of FFA.

The results demonstrate that expression of ester synthase ES9 in *E. coli* MG1655 DV2 ΔfadD results in the production of high levels of esters and low levels of free fatty acids in the presence of ethanol. Furthermore, this example demonstrates that expression of 'TesA in *E. coli* MG1655 DV2 ΔfadD resulted in the production of a low level of esters and a high level of free fatty acids in the presence of ethanol.

Example 9

This example demonstrates that expression of an ester synthase alone, without co-expression of an acyl-CoA synthase or a thioesterase, can be used to produce esters in vivo in the presence of methanol.

Figure 7:
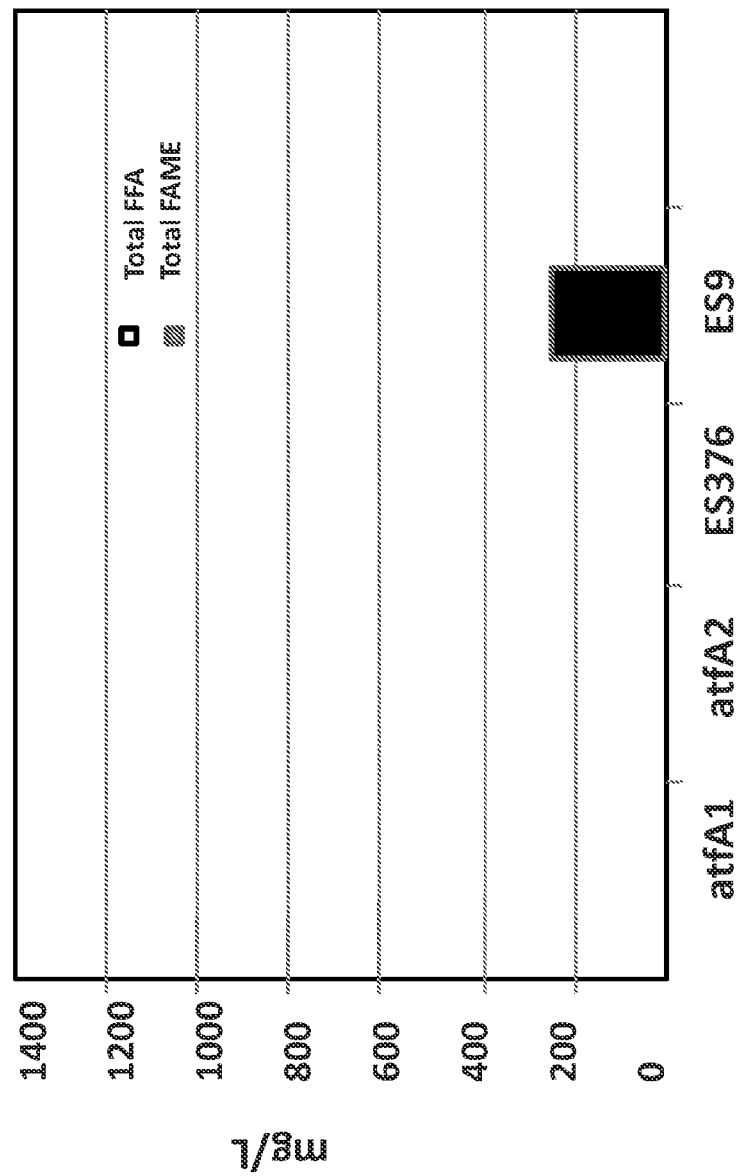
FIG. 7 depicts the production of FFA and/or FAME in accordance with Example 8, without co-expression of acyl-CoA synthase or a thioesterase, but in the presence of methanol in shake flasks. The amount of FFA produced was below the limit of detection. Lower levels of overall titers, as compared to those obtained in the presence of ethanol, were also observed in cultures expressing atfA1, atfA2, ES8, and ES9. However, ES9 produced substantial amount of FAME.

Seed cultures of *E. coli* MG1655 DV2 ΔfadD of Example 4, each carrying one of the following plasmids:
(1) a plasmid containing a polynucleotide encoding *Alcanivorax borkumensis* SK2 ester synthase atfA1 (GenBank Accession No. YP_694462);
(2) a plasmid containing a polynucleotide encoding *Alcanivorax borkumensis* SK2 ester synthase atfA2 (GenBank Accession No. YP_693524);
(3) a plasmid containing a polynucleotide *Marinobacter hydrocarbonoclasticus* DSM 8798 ester synthase ES8 (GenBank Accession No. ABO21020); and
(4) a plasmid containing a polynucleotide *Marinobacter hydrocarbonoclasticus* DSM 8798 ester synthase ES9 (GenBank Accession No. ABO21021)
were grown in shake flask cultures and induced with 1 mM IPTG and 2% (v/v) methanol. At 24-h post induction, aliquots from each culture were extracted and analyzed by GC-FID for fatty acid and ester content. The amounts of free fatty acid (FFA) and fatty acyl methyl ester (FAME) produced in each culture were shown in FIG. 7.

The amount of overall product or titer observed for FFA and FAME was reduced in the presence of methanol as compared to the amount of overall titer observed in the presence of ethanol (see FIG. 6). Here the amount of FFA produced was below the limit of detection, therefore it is possible that FFA was produced in the presence of methanol, albeit at low concentrations. Lower levels of overall titers, as compared to those obtained in the presence of ethanol, were also observed in cultures expressing ester synthases atfA1, atfA2, and ES8.

The results demonstrate that expression of ester synthase ES9 in *E. coli* MG1655 DV2 ΔfadD resulted in the production of esters in the presence of methanol.

Example 10

This example demonstrates that expression of an ester synthase alone, without co-expression of an acyl-CoA synthase or a thioesterase, can be used to produce esters in vivo in the presence of ethanol or methanol.

*E. coli* MG1655 DV2 ΔfadD carrying a plasmid containing a polynucleotide encoding *M. hydrocarbonclasticus* DSM 8798 ester synthase ES9 (GenBank Accession No. ABO21020), was grown in shake flask cultures and induced with 1 mM IPTG and either (1) 2% (v/v) ethanol or (2) 2% (v/v) methanol. Aliquots from each culture were extracted at 18, 24, 48, and 68 hours post induction, and analyzed by GC-FID for fatty acid and ester content. The amounts of fatty acyl methyl ester (FAME) or fatty acyl ethyl ester (FAEE) produced in each culture were shown in FIG. 8, as well as the total amount of FAME or FAEE plus free fatty acid (FFA).

Figure 8:
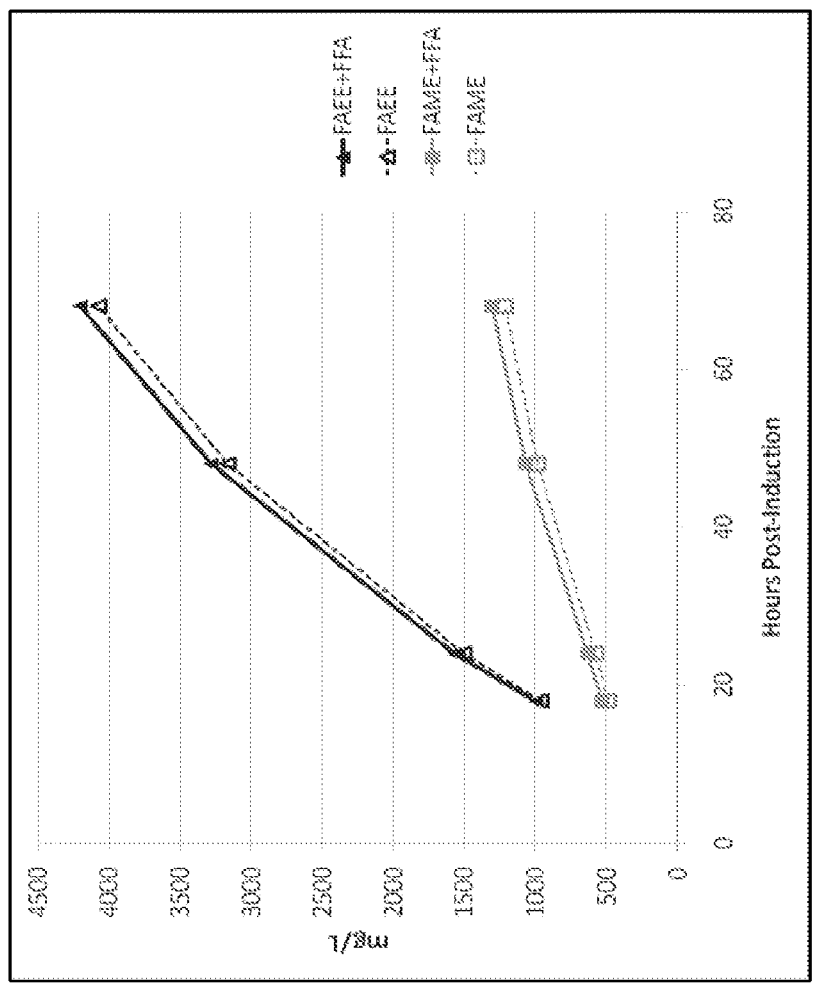
FIG. 8 depicts a post-induction time course of fatty ester production by *E. coli* MG1655 DV2 ΔfadD expressing ES9, without co-expression of an acyl-CoA synthase or a thioesterase.

As shown in FIG. 8, significantly higher levels of esters were produced in the presence of ethanol (FAEE) as compared to the levels of esters produced in the presence of methanol (FAME) throughout the post-induction time course. Low levels of free fatty acids were produced both in the presence of ethanol and in the presence of methanol.

The results demonstrate that expression of ester synthase ES9 in *E. coli* MG1655 DV2 ΔfadD resulted in high production levels of esters and low production levels of free fatty acids in the presence of methanol and ethanol. Furthermore, this example demonstrates that ester production in *E. coli* MG1655 DV2 ΔfadD expressing ester synthase ES9 was significantly higher in the presence of ethanol than in the presence of methanol.

Example 11

This example describes the construction of an ester synthase mutant library, wherein each member contains an amino acid substitution for glycine at position 395 of ES9.

When the sequence of the ester synthase ES9 of *M. hydrocarbonoclasticus* DSM 8798 (GenBank Accession No. ABO21021.1) was subjected to a BLAST search (http://www.ncbi.nlm.nih.gov/), several bacterial ester synthase homologues were identified. Sequence alignment of these microbial ester synthases revealed a general pattern of an acidic amino acid at position 395 of glutamic acid or aspartic acid, notwithstanding the fact that the reported sequence of ester synthase ES9 contained a glycine at amino acid 395.

The glycine residue at position 395 of ES9 was mutated to each of the 20 conventional amino acid residues in order to evaluate the effect of amino acid substitution at this position. The mutants were created using Stratagene's QuikChange® Multi Site-Directed Mutagenesis Kit (Stratagene, La Jolla, Calif.). Primer G395Xf, as shown in Table 7, was used in conjuction with a vector-specific primer to generate a pool of 3' ester synthase fragments encoding all 20 possible amino acid residues at position 395. A revserse primer complementary to the 5'-portion of G395Xf, designated as G395Xr, was used in conjuction with a vector-specific primer to generate the 5' ester synthase fragments. Each of the 3'-fragments was then assembled with the 5' fragments via overlap extension to reconstitute a randomized pool of gene sequences encoding a sequence with 20 different amino acid residues at position 395.

TABLE 7

| Primer | Primer Sequence 5' - 3' |
|---|---|
| G395Xf | CCATTTCCAACGTGCCCGGCCCGGAANNKACGCTGTATTATGAAGG,<br>(SEQ ID NO: 47)<br>wherein N is any base and K is G or T |
| G395Xr | TTCCGGGCCGGGCACGTTGGAAATGG<br>(SEQ ID NO:52) |

The randomized pool of ester synthase mutant sequences were then electroporated into electrocompetent *E. coli* MG1655 DV4/1/2 Km$^R$Cm$^R$/pKD46 cells, which were prepared in accordance with the description below.

A first gene containing the promoter and open reading frame for chloramphenicol resistance (SEQ ID NO:157) was obtained from plasmid pKD3 (see, Datsenko et al., supra). Separately, a portion of a second gene containing the promoter and the first 531 bases of the kanamycin resistance gene (SEQ ID NO:158) was obtained from plasmid pKD13 (see, Datsenko et al., supra). A resistance cassette was constructed by first joining the first gene with the second gene, with the first gene being upstream of the second gene. A 50-base pair homologous sequence to the 3'-end of the lacZ gene sequence (SEQ ID NO:159) was added downstream from the chloramphenicol resistance gene, and a lad gene sequence (SEQ ID NO:160) was added upstream from the partial kanamycin resistance gene. This resistance cassette was then used to transform an *E. coli* MG1655 DV4 strain, which had been previously transformed with pKD46 as described below.

A plasmid pKD46 (see, Datsenko et al., supra) was transformed into *E. coli* MG1655 DV4 (see, Example 3). This DV4/pKD46 strain was grown on a solid media containing 100 µg/mL cabenicillin overnight at 32° C. A single colony was then used to inoculate an overnight culture of LB containing 100 µg/mL carbenicillin. After 16-h of growth at 32° C., the DV4/pKD46 culture was diluted 1 to 500 into an LB medium containing 100 µg/mL carbenicillin, arabinose and MgCl$_2$ to induce expression of the recombinase genes from pKD46. Growth was monitored by measuring OD600, and when it reached about 0.6, the cells were made electrocompetent and transformed with the resistance cassette.

The transformed cells were allowed to recover for 3 h in non-selective SOC media before plating on solid chloramphenicol-selective media, containing 34 µg/mL chloramphenicol, X-gal, and IPTG. Correct insertions were confirmed using colony PCR, blue/white screening and DNA sequencing. This strain is named *E. coli* MG1655 DV4/1/2 Km$^R$Cm$^R$/pKD46. It is then subject to arabinose treatment for 3-4 h before the ester synthase mutant sequences were transformed Following transformation, the cultures was allowed to recover and plated onto LB agar medium containing 50 µg/mL kanamycin and allowed to grow overnight at 32° C. 96 clones from this plate were sequenced to verify the types of intended mutations at ES9 position 395. The capacity to make fatty acid/fatty esters of each was then assessed.

A seed culture of each clone was grown in 96-well plates in LB broth supplemented with 50 µg/mL kanamycin at 32° C. After a 6-h growth, the cultures were diluted 1 to 10 into 2N-BT (2% glucose, nitrogen limited medium, 0.2M Bis- Tris, pH 7.0, 0.1% Triton) plus 50 μg/mL kanamycin and grown overnight at 32° C. After overnight growth, the culturs were diluted again 1 to 10 into 4N-BT (4% glucose, nitrogen limited medium, 0.2 mM Bis-Tris, pH 7.0, 0.1% Triton) and grown at 32° C. for 6 h. IPTG and ethanol were then added to each culture to achieve a final concentration of 1 mM and 2% (v/v), respectively. 22-h post induction, the cultures were acidified using 40 μL 1 M HCl and extracted with 400 μL n-butylactate. The amounts of fatty species (including, e.g., fatty acids and fatty esters) in the extractants were measured using GC-FID.

Figure 9:
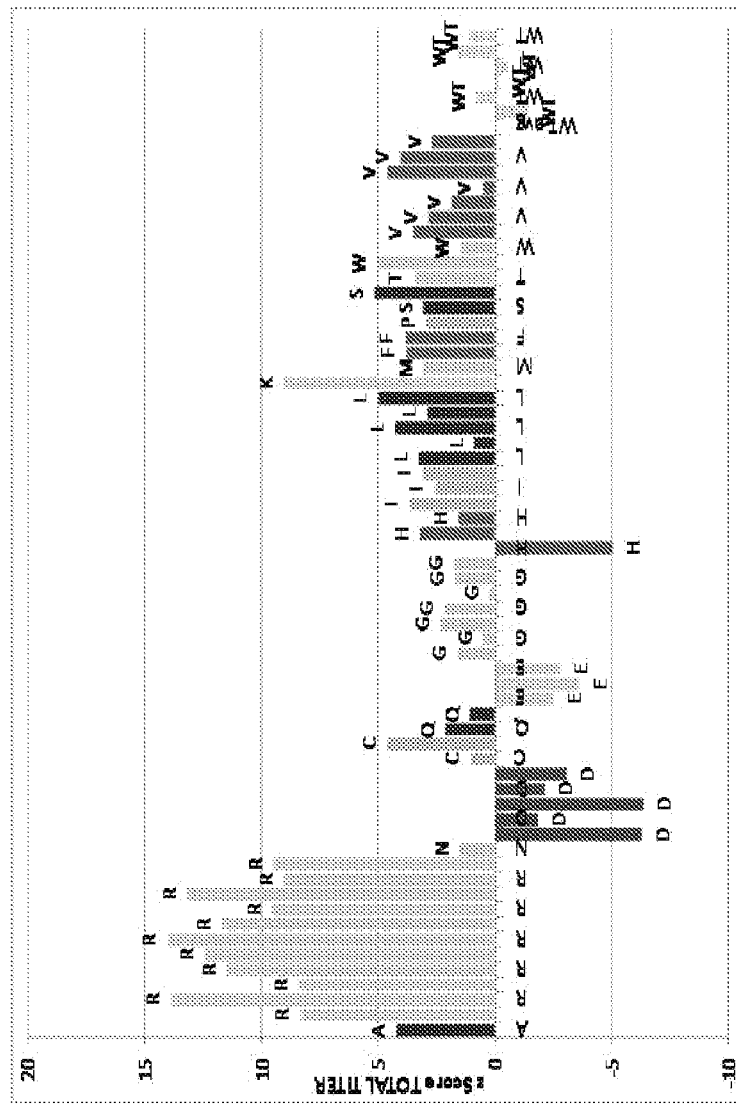
FIG. 9 depicts the z-scores of fatty acid/fatty ester production by the strains of the ES9 position 395 mutageneisis library, as described in Example 11.

As can be seen FIG. 9, which depicts the z scores of the production titers from the mutant and wild type strains, and wherein the median titer of the production strain expressing wild type ES9 was set at 0, the samples wherein the glycine residue at position 395 of ES9 was replaced by either an argine or a lysine residue resulted in the most significant increases in fatty species production. For example, the z score for the G395R mutant strain was above 10, and the z score for the G395K mutant strain was about 9. Moreover, p-values were calculated to assess statistical significance in terms of the improvements of titer. The productivity improvement of the G395R mutant strain had a p-value of 1.74E-19, and the productivity improvement of the G395K mutant strain had a p-value of 5.42E-05, and those improvements were statistically significant.

Example 12

This example demonstrates that expression of an ester synthase mutant of ester synthase ES9 from *Marinobacter hydrocarbonoclasticus*, wherein glycine at amino acid residue 395 of the reported sequence was replaced with a number of other amino acid residues, can be used to produce esters in vivo in the presence of a suitable alcohol substrate.

The following primers were used to remove the ester synthase mutant and wild type fragments from their *E. coli* MG1655 DV4/1/2 Km$^R$Cm$^R$/pKD46 transformants of Example 11:

```
                                     (SEQ ID NO: 37)
ES9BspHF    5' - ATCATGAAACGTCTCGGAAC - 3';
and
                                     (SEQ ID NO: 38)
ES9XhoR     5' - CCTCGAGTTACTTGCGGGTTCGGGCGCG - 3'
```

The ester synthase fragments that were obtained from the *E. coli* MG1655 DV4/1/2 Km$^R$Cm$^R$/pKD46 transformants using these primers were wild type ES9, and mutants G395R, G395S, G395K, G395S, and G395D. These fragments were then cloned downstream of the IPTG inducible promoter in a pCL1920 vector using NcoI and HindIII restriction sites.

The resulting plasmids were transformed into electrocompetent *E. coli* MG1655 DV2 ΔfadD (see, Example 4) and plated on LB plates containing 100 mg/L spectinomycin, incubated overnight at 37° C., and purified.

Purified DV2 ΔfadD strains expressing ES9, and mutants G395R, G395S, G395K, G395S, and G395D were grown in 15 mL shake flasks and induced with 1 mM IPTG and 2% (v/v) methanol. Post induction, samples were taken from each shake flask at the 15.5 h, 40 h and 65 h, and the production levels of free fatty acids and FAME were determined at these time points using GC-FID. The results are shown in FIG. 10A.

Cell growth during fermentation was also followed by taking small samples of the fermentation broth and measuring OD600. The result is shown in FIG. 10B.

Figure 10A:
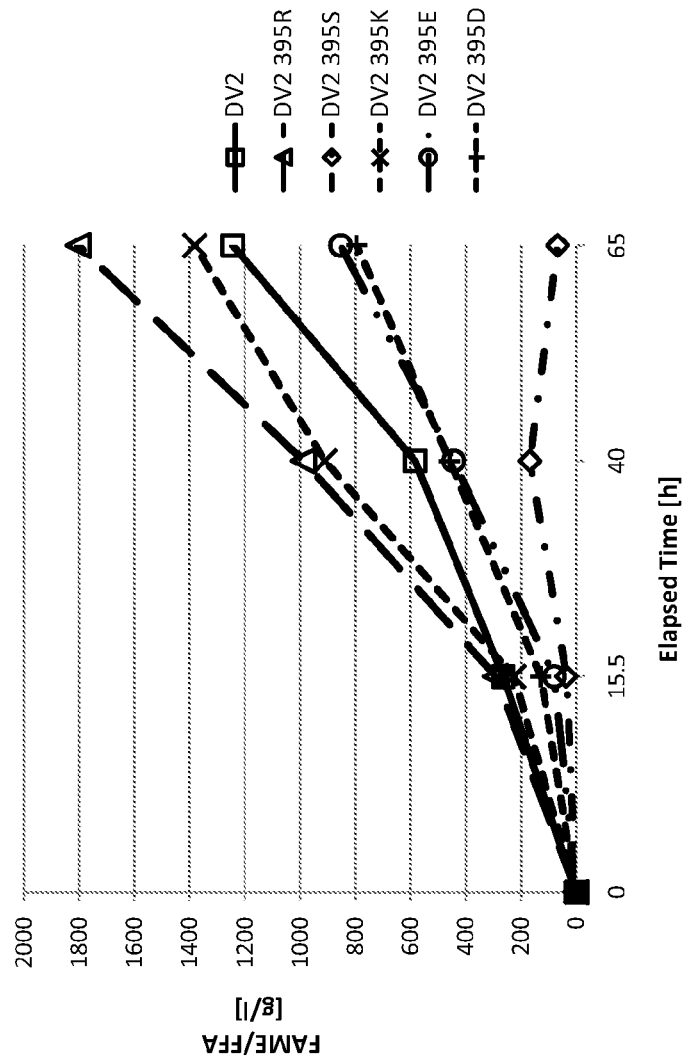
FIG. 10A depicts in vivo production of free fatty acids and/or fatty esters by the *E. coli* DV2 ΔfadD expressing ES9, and ES9 mutants G395R, G395K, G395S, G395D, and G395E.
Figure 10B:
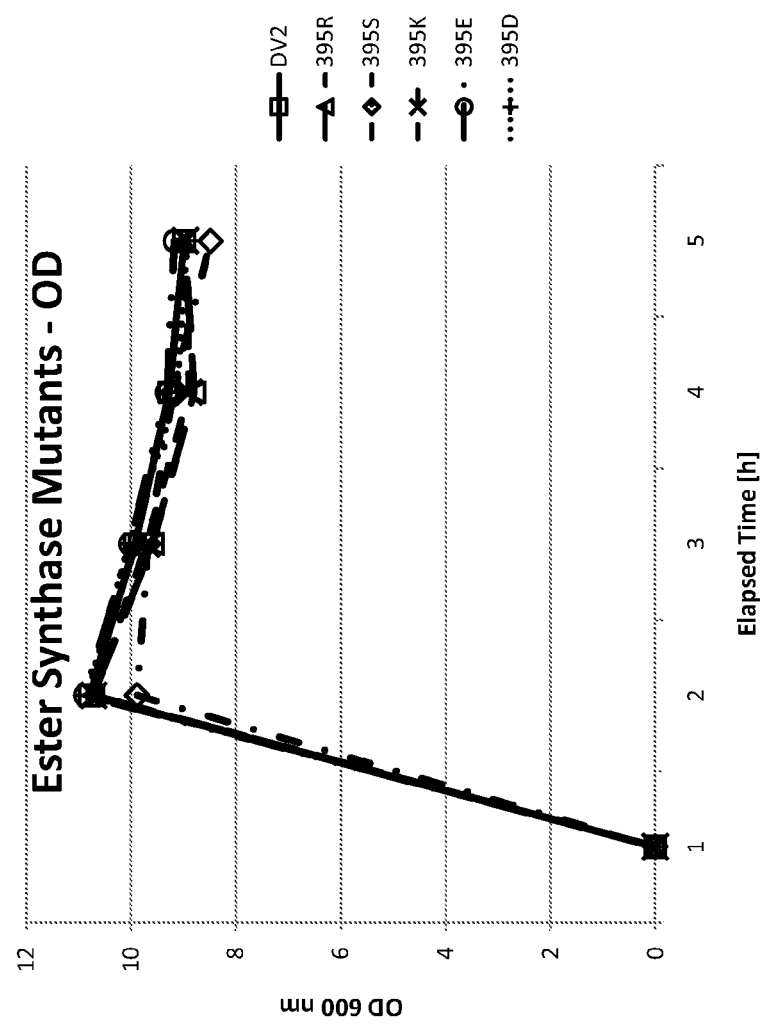
FIG. 10B depicts OD600 obtained from the strains during fermentation.

As shown in FIG. 10A, strains expressing ES9, which has a glycine residue at position 395, as well as strains expressing the G395R, G395K, G395D and G395E mutants of ES9, all produced substantial FAME and free fatty acids in the presence of methanol. In contrast, the strain expressing the G395S mutant produced little if any FAME and/or free fatty acids.

In the presence of methanol, the production strain expressing the G395R mutant ester synthase produced about 1,800 g/L FAME/FFA, whereas the production strain expressing the G395K mutant ester synthase produced about 1,400 g/L FAME/FFA. In comparison with the amount of FAME/FFA produced by the production strain comprising the wild type ester synthase ES9, these two mutants appeared to have substantially improved capacity to produce fatty acids and derivatives thereof. Substituting the glycine residue at positon 395 of ES9 with acidic amino acid residues did not provide the production strain with an improved capacity to produce fatty acids and/or derivatives. Nor did substituting the glycine residue at positon 395 of ES9 with a cysteine residue The results demonstrate that the glycine mutation to a basic amino acid residue such as a lysine or an arginine residue at amino acid position 395 in the reported sequence of ester synthase ES9 provides an improved ester synthase variant that can be utilized to achieve an improved production of fatty acids and/or fatty acid derivatives.

Example 13

This example describes ester synthase homologs with altered activity and/or specificity towards acyl-ACPs over acyl-CoA or beta-hydroxy acyl-ACP. Four ester synthase homologs were identified based on bioinformatic analyses and described in the table below. These ester synthase homologues were evaluated for activity:

TABLE 8

| Given names | Organism source | Accession number | SEQ ID |
|---|---|---|---|
| ES1 | *Marinobacter algicola* DG893 | ZP_01893763 | SEQ ID NO: 39 |
| ES2 | *Limnobacter* sp. MED105 | ZP_01915979 | SEQ ID NO: 41 |
| ES3 | Marine metagenome | EDJ50241 | SEQ ID NO: 43 |
| ES4 | Whalefall sample #3 | 2001496676* | SEQ ID NO: 45 |

*IMG identification number

The percent identity and percent similarity of these homologues to the reported sequence of ester synthase ES9 are listed in the table below:

TABLE 9

| | Ester Synthase ES9 | |
|---|---|---|
| | % identity | % similarity |
| ES1 | 85 | 91 |
| ES2 | 51 | 68 |
| ES3 | 39 | 56 |
| ES4 | 36 | 56 |

The nucleotide sequences of the four ester synthase homologs above were *E. coli* codon-optimized (SEQ ID NOs: 40, 42, 44, 46) and synthesized using DNA2.0 (DNAstar, Menlo Park, Calif.) and then cloned downstream of the IPTG inducible Ptrc promoter in a pCL1920 vector using the NcoI and HindIII sites.

The resulting plasmids were transformed into *E. coli* MG1655 DV2 ΔfadD for evaluation in shake flasks. The resultant production titers of FAME, when the cells were fed with methanol, were indicated in FIG. 11. The resultant production titers of FAEE, when the cells were fed ethanol, were indicated in FIG. 12.

Example 14

This example describes a fermentation process to produce a fatty acid and/or fatty acid derivative composition using the genetically modified microorganisms described herein.

A fermentation and recovery process was used to produce biodiesel of commercial grade quality by fermentation of carbohydrates.

A fermentation process was developed to produce a mix of fatty acid ethyl esters (FAEE) and fatty acid methyl esters (FAME) for use as a biodiesel using the genetically engineered microorganisms described Examples 1-12. The fermentation is carried out in any manner known to those of ordinary skill in the art. For example, the fermentation is carried out in a 2- to 10-L lab scale fermentor. These exemplary protocols can be scaled up as any other *E. coli* fermentation, using methods known to one of ordinary skill in the art.

In one embodiment, a fermentation run was carried out in a 2-L fermentor. *E. coli* cells from a frozen stock were grown in a defined medium consisting of 4.54 g/L $K_2HPO_4$ trihydrate, 4 g/L of $(NH_4)_2SO_4$, 0.15 g/L of $MgSO_4$ heptahydrate, 20 g/L glucose, 200 mM Bis-Tris buffer (pH 7.2), 1.25 mL/L trace mineral solution, and 1.25 mL/L vitamin solution. The trace mineral solution comprised 27 g/L $FeCl_3.6H_2O$, 2 g/L $ZnCl_2.4H_2O$, 2 g/L $CaCl_2.6H_2O$, 2 g/L $Na_2MoO_4.2H_2O$, 1.9 g/L $CuSO_4.5H_2O$, 0.5 g/L $H_3BO_3$, and 100 mL/L concentrated HCl. The vitamin solution comprised 0.42 g/L riboflavin, 5.4 g/L pantothenic acid, 6 g/L niacin, 1.4 g/L pyridoxine, 0.06 g/L biotin, and 0.04 g/L folic acid.

Fifty (50) mL of a culture described herein was grown overnight and subsequently used to inoculate 1 L of a medium containing 0.5 g/L $(NH_4)_2SO_4$, 2.0 g/L $KH_2PO_4$, 0.15 g/L $MgSO_4$ heptahydrate, 0.034 g/L ferric citrate, 2.5 g/L bacto casamino acids, 10 g/L glucose, 1.25 mL/L trace mineral solution 2, and 1.25 mL/L vitamin solution. The trace mineral solution 2 contained 2 g/L $ZnCl_2.4H_2O$, 2 g/L $CaCl_2.6H_2O$, 2 g/L $Na_2MoO_4.2H_2O$, 1.9 g/L $CuSO_4.5H_2O$, 0.5 g/L $H_3BO_3$, and 100 mL/L of concentrated HCl. The vitamin solution was the same as described for the inoculum culture medium.

The fermentor was equipped with temperature-, pH-, agitation-, aeration-, and dissolved oxygen-controls. The preferred fermentation conditions include a templerature of 32° C., pH of 6.8, and a dissolved oxygen (DO) level of about 30% of saturation. The pH was maintained by additions of $NH_4OH$, which also acted as a nitrogen source for cell growth. When the initial glucose was almost consumed, a feed consisting of 600 g/L glucose, 3.9 g/L $MgSO_4$ heptahydrate, 1.6 g/L $KH_2PO_4$, 2.5 g/L casamino acids, 0.05 g/L Ferric citrate, 20 mL/L trace minerals solution 2, and 2 ml/L vitamin solution was supplied to the fermentor. The feed rate was set up to allow for a cell growth rate of 0.3 $h^{-1}$, for up to a maximum of 10 g glucose/L/h, at which point it was fixed. This rate was maintained for the remainder of the fermentation run as long as glucose did not accumulate in the fermentor. By avoiding glucose accumulation, it was possible to reduce or eliminate the formation of by-products such as acetate, formate, and ethanol, which are otherwise commonly produced by *E. coli*. In the early phases of growth, the production of FAEE was induced by the addition of 1 mM IPTG and 10 ml/L of pure ethanol. The fermentation was continued for a period of 3 days.

Ethanol was added several times during the run to replenish what was consumed by the cells for the production of fatty ethyl esters, but mostly what was lost by evaporation in the off-gas. The additions helped to maintain the concentration of ethanol in the fermentation broth at a level of between 10 and 20 mL/L, in order to promote efficient production without inhibiting cell growth. The progression of the fermentation run was followed by measurements of OD600, glucose consumption, and ester production.

This fermentation protocol was also scaled up to a 700-L fermentor. The analytical methods utilized following the fermentation runs are described in the following examples.

Example 15

This example describes the analytical procedures used to detect glucose consumption, and productions of free fatty acids and/or fatty acid esters. Glucose consumption throughout the fermentation was analyzed by High Pressure Liquid Chromatography (HPLC). The HPLC analysis was performed according to methods commonly used in the art for measuring sugars and organic acids, which typically involve the following equipment and conditions: Agilent HPLC 1200 Series (Agilent Technology, Santa Clara, Calif.) with Refractive Index detector; Aminex HPX-87H column, 300 mm×7.8 mm (Catalogue: 125-0140); column temperature: 50° C.; pH range: 1-3; mobile phase: 0.005 M $H_2SO_4$ (aqueous); flow rate: 0.6 mL/min; injection volume: 5 µL; run time: 25 min.

The production of fatty acid methyl or ethyl ester was analyzed by gas chromatography with flame ionization detector (GC-FID). Samples from the fermentation broth were extracted with ethyl acetate in a volume ratio of 1:1. After vigorous vortexing, the samples were centrifuged and the respective organic phases ware analyzed by GC. The analysis conditions were as follows:

Instrument: Trace GC Ultra, Thermo Electron Corp. (Marietta, Ohio) with Flame ionization detector (FID) detector;
Column: DB-1 (1% diphenyl siloxane; 99% dimethyl siloxane) Col UFM 1/0.1/5/0.1 DET from Thermo Electron Corp. (Part# UFMC00001010401; S/N 520070046), with Phase pH of 5, FT of 0.1 µm, length of 5 m and an internal diameter of 0.1 mm;
Inlet conditions: 300° C., split 1/300 with a split flow of 150 mL/min, total run time: 2 min;
Carrier gas/flow rate: Helium/0.5 mL/min;
Block temperature: 260° C.;
Oven temperature: 0.3 min hold at 140° C.; ramp at 100° C./min to 300° C.; hold for 0.05 min, total run time: 4 min.
Detector temperature: 300° C.;
Injection volume: 1 µL.

Production of fatty methyl or ethyl ester was followed by gas chromatography linked with a mass spectrometry detector (GC-MS). Samples from the fermentation broths were extracted with ethyl acetate or butyl acetate in a volume ratio of 1:1. After vigorous vortexing, the samples were centrifuged and the respective organic phases were analyzed by GC-MS on an Agilent 6850 (Agilent Technology, Santa Clara, Calif.) equipped with a 5975B VL MSD. Ions were extracted by single ion monitoring. The analysis conditions were as follows:
Oven temperature: 3.00 min hold at 100° C., ramp at 20° C./min to 320° C. and hold for 5 min, with a total run time of 19 min;

Capillary column. DB-5 MS UI, capillary 30.0 m×250 µM×0.250 µm×0.25 µm nominal;
Carrier gas/flow rate/pressure: Helium/1.2 mL/min/12.56 psi;
Inlet condition: 320° C. splitless;
Total flow rate: 16.2 mL/min;

Example 16

This example demonstrates that fatty acid ethyl esters can be produced by fermenting an *E. coli* strain expressing an ester synthase, in the absence of a thioesterase and/or an acyl-CoA synthase.

*E. coli* MG1655 DV2 and DV2 ΔfadD, as described in Examples 2 and 4, respectively, were transformed with plasmid pDS57 (SEQ ID NO:23), as described in Example 5. The resulting DV2 pDS57 and DV2 AfadD pDS57 strains were grown in 2- and 5-L fermentors according to the fermentation protocol of Example 14. Representative results of the analysis of FAEE, FFA, and the total yield of FAEE for each strain are shown in Table 10. The yield is expressed as the grams of product obtained per 100 grams of carbon source used.

TABLE 10

| Parameter | DV2 pDS57 | DV2 ΔfadD pDS57 |
|---|---|---|
| FAEE concentration (g/L) | 5.9 | 7.3 |
| FFA concentration (g/L) | 0.3 | 0.5 |
| Yield of FAEE on glucose (%) | 5.6 | 6.1 |

The results indicate that high levels of fatty acid ethyl esters and low levels of free fatty acids can be produced by fermentation of *E. coli* strains DV2 and DV2 ΔfadD expressing ester synthase ES9.

Example 17

This example demonstrates that fatty acid esters can be produced by feeding fatty acids and alcohols to a microbial strain containing a native (i.e., non-recombinant) ester synthase. A strain of *Funibacter jadensis* was used as an example of a microbial strain containing such an ester synthase. It was cultured in a seawater medium.

A seawater medium was prepared and autoclaved: 23.6 g/L NaCl, 0.64 g/L KCl, 4.53 g/L MgCl$_2$×6H$_2$O, 5.94 g/L MgSO$_4$×7H$_2$O. The pH was adjusted to 7.2 with NaHCO$_3$.

Figure 13:
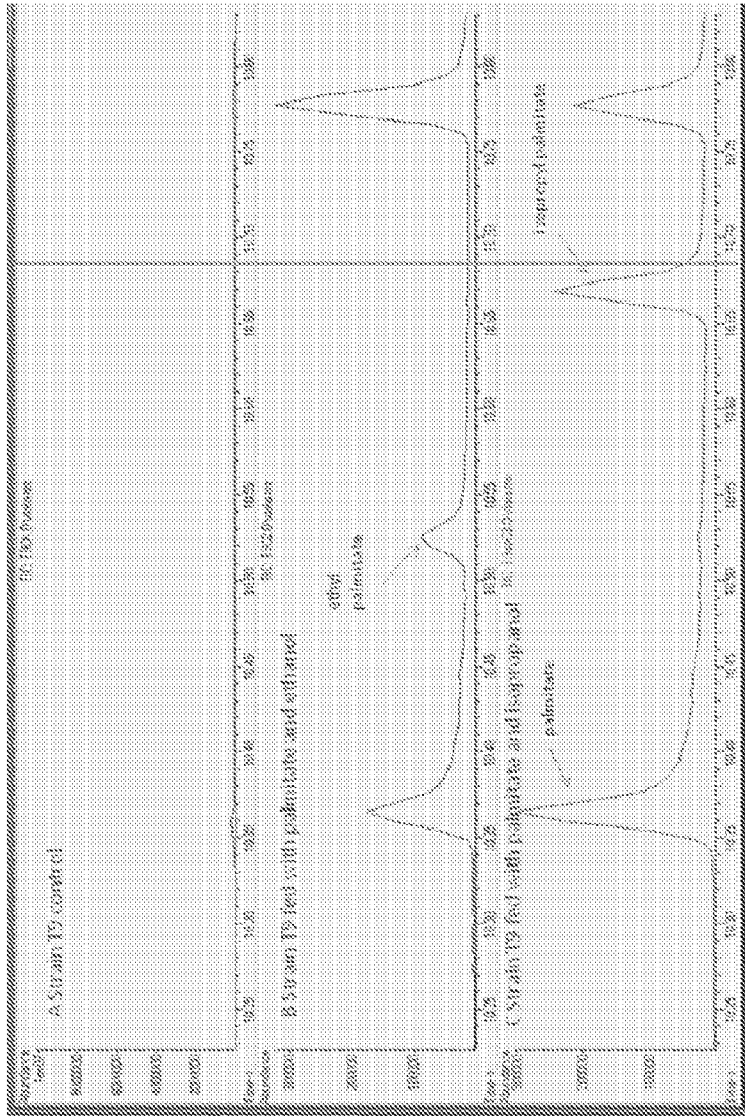
FIG. 13 is a GC/MS trace following ester production from *F. jadensis* T9 strain fed with sodium palmitate and short chain alcohols. The top panel is a no-alcohol feeding control. The middle panel depicts the products made as result of ethanol feeding. The lower panel depicts the products made as a result of isopropanol feeding.
Figure 14:
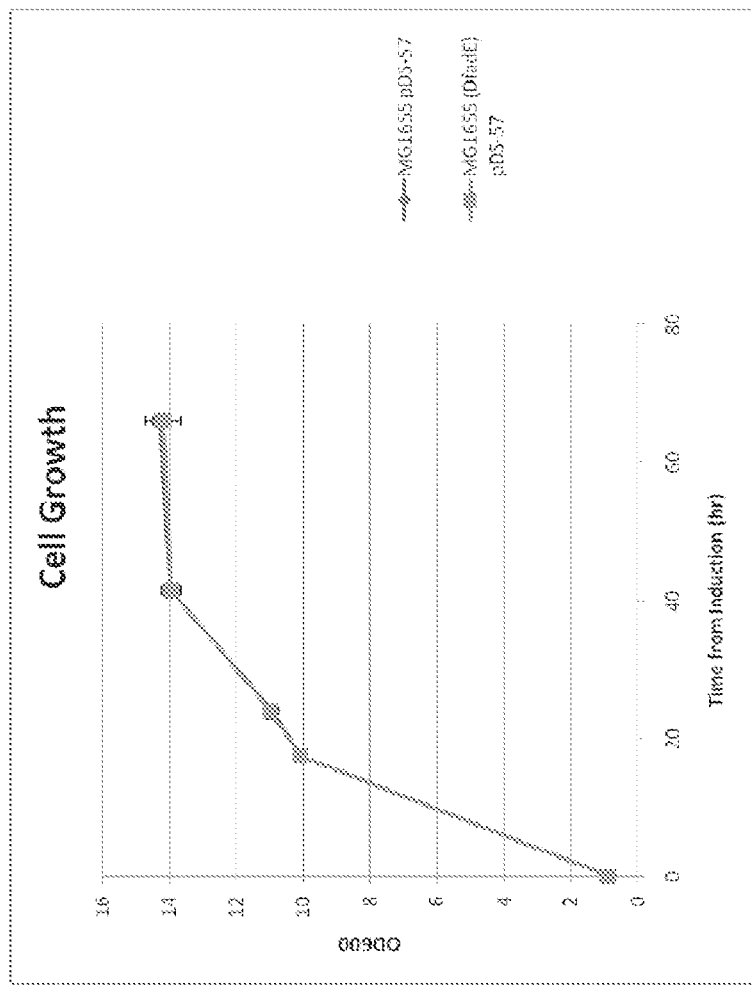
FIG. 14 compares the cell growth profiles of fatty esters production processes involving recombinant host strains with or without an attenuated/deleted fadE, as described in Example 18. In this example, acyl-ACP and ethanol were used as substrates.
Figure 15:
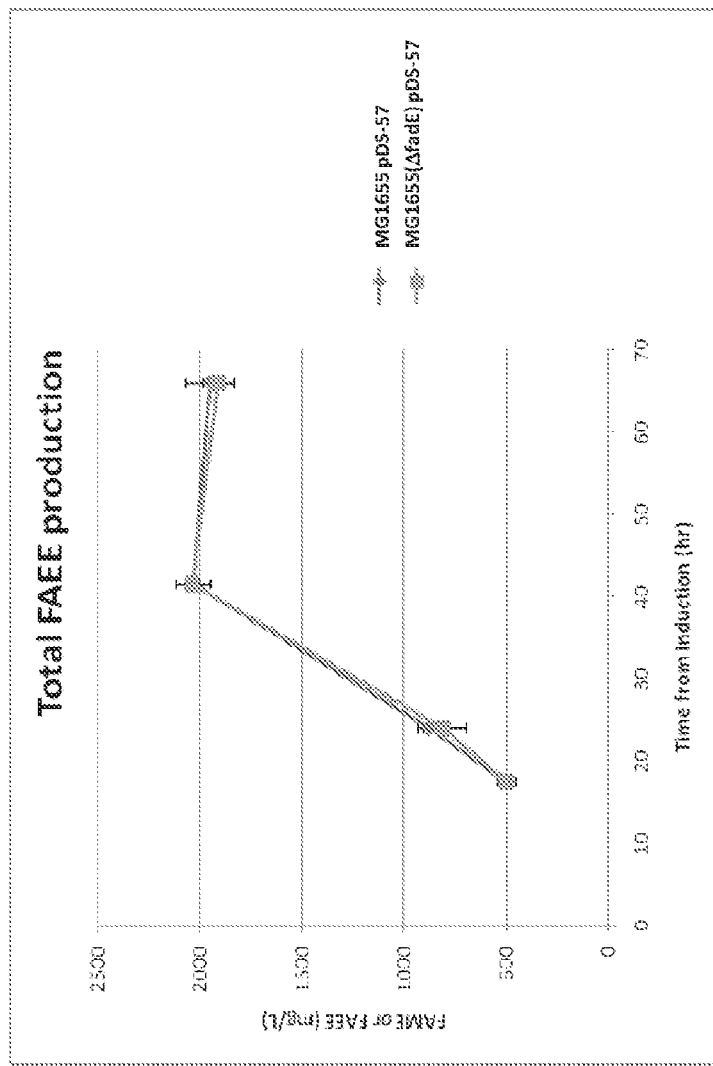
FIG. 15 compares the total fatty ester production using recombinant host strains with or without an attenuated/deleted fadE, as described in Example 18. In this example, acyl-ACP and ethanol were used as substrates.

The strain *Funibacter jadensis* T9 (DSM 12178) was obtained from DSMZ (http://www.dsmz.de). The strain was grown in 25 mL of the seawater medium, supplemented with 100 µL of sodium palmitate (1% in H$_2$O) and one of four alcohols listed in Table 11. After 18 h of growth at 30° C., the culture broths were extracted with 20 mL of ethyl acetate. Then the respecitive ethyl acetate phases of ethyl acetate extractants were analyzed with GC/MS. The types of esters that were produced were listed in Table 11. FIG. 13 depicts the GC/MS spectra of ethyl palmitate and isopropyl palmitate produced by *F. jadensis* T9 strain fed with ethanol and isopropanol, respectively, in the middle and lower panels.

TABLE 11

| Alcohols | Esters produced |
|---|---|
| Ethanol (250 µL) | Ethyl palmitate |
| Isopropanol (250 µL) | Isopropyl palmitate |
| Butanol (250 µL) | Butyl palmitate |

TABLE 11-continued

| Alcohols | Esters produced |
|---|---|
| Hexadecanol (250 µL, 100% W/V in DMSO) | hexadecanoyl hexadecanoate |
| Control (250 µL H2O) | palmitate |

Example 18

This example demonstrates the production of fatty acid derivatives in a wild-type *E. coli* host cell in the presence of an unattenuated level of endogenous fadE. The gene fadE encodes an acyl-CoA dehydrogenase, which catalyzes the initial step in the degradation of fatty acyl-CoAs. Therefore, fadE is often considered necessary when fatty acid derivatives are made using acyl-CoAs as substrates. However, the fatty acid derivative production cells of the present invention can use acyl-ACPs as substrates. Thus the presence of an acyl-CoA dehydrogenase will not necessarily cause degradation of the substrates. This example demonstrates that, indeed, the endogenous expression of fadE can be left intact without affecting the production of fatty acid derivatives.

Figure 12:
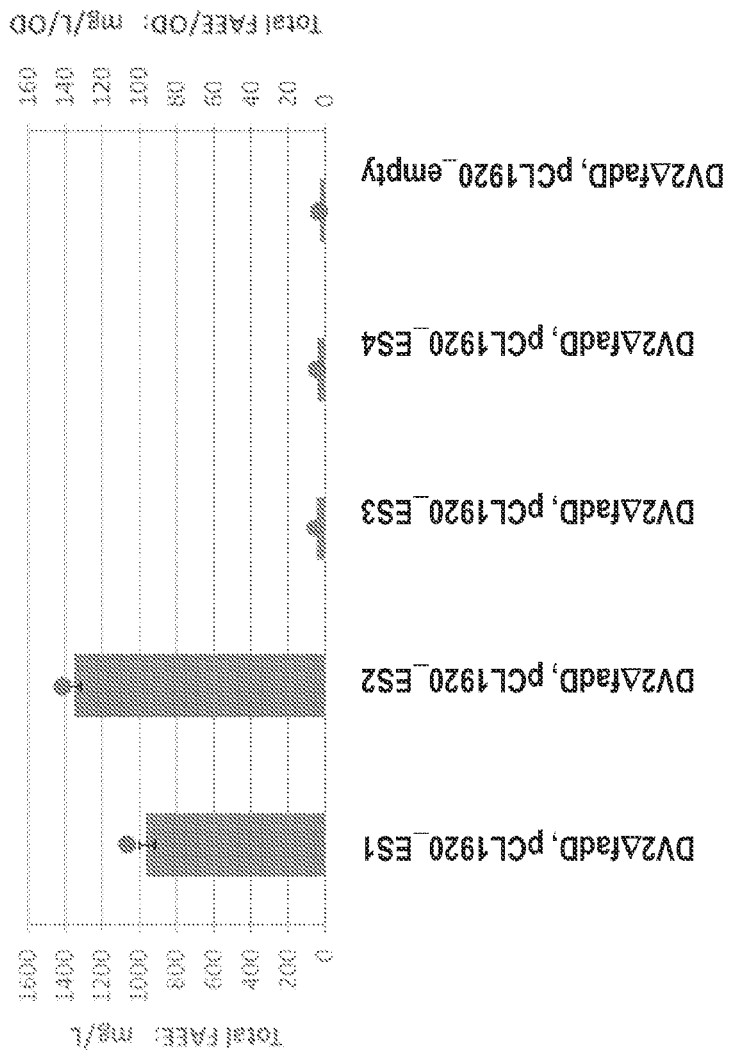
FIG. 12 depicts fatty acid ethyl ester production titers by ES1, ES2, ES3, and ES4, the homologs of ES9, in accordance with Examples 12-13, which converted acyl-ACPs and ethanol into ethyl esters.

Plasmid pDS57 (SEQ ID NO:23, see, Example 6), which places ES9 under the transcriptional control of the trc promoter, was transformed into an electrocompetent *E. coli* strain MG1655. The same plasmid was transformed into strain *E. coli* MG1655 D1 (or *E. coli* MG1655ΔfadE, see, Example 1) to serve as a comparison. The strains were grown in shake flasks and were evaluated using the standard shake flask fermentation protocol, such as the one described in Example 7, supra. When strains were induced with 1 mM IPTG, they were also supplemented with ethanol, to a final volume of 2% (v/v). Four time points were taken and the strains were analyzed for growth, and for fatty acid ethyl ester production. The results are depicted in FIGS. 11 and 12. Both strains had nearly identical growth profiles (FIG. 11) and fatty acid ethyl ester production profiles (FIG. 12). Strain MG1655 pDS57 was able to produce about 2 g/L FAEE, demonstrating that ES9 is capable of producing ester directly in a wild-type strain without an attenuated fadE.

It was also determined that free fatty acid accumulation was less than 20 mg/L total for each strain.

Example 19

This example provides an exemplary method for the expression of an ester synthase polypeptide in a *Saccharomyces cerevisiae*. Endogenous thioesterases and/or acyl-CoA synthases or other fatty acid degradation enzymes, if present, can be attenuated or functionally deleted using the appropriate methods as described herein.

The yeast episomal plasmid (YEp)-type vector pRS425 (Christianson et al., *Gene* 110:119-122 (1992)) contains sequences from the *Saccharomyces cerevisiae* 2 micron endogenous plasmid, a LEU2 selectable marker, and sequences based on the backbone of a multifunctional phagemid, pBluescript II SK(+). The *Saccharomyces cerevisiae*'s strong, constitutive glyceraldehyde-3-phosphate dehydrogenase (GPD) promoter is cloned between the SacII and SpeI sites of pRS425 using the method described by Jia et al., *Physiol. Genomics* 3:83-92 (2000) to produce pGPD-425 (SEQ ID NO:50). A NotI site is introduced into the BamHI site of pGPD-425, giving a NotI site flanked by BamHI sites, and this plasmid is called pY75 (SEQ ID NO:48).

An ester synthase gene of interest, such as, for example, one encoding a polypeptide selected from SEQ ID NOs:18, 24, 25, and 26, or a variant thereof, is first treated such that the DNA fragments can be ligated into the unique NotI site of pY75 (SEQ ID NO:48). Prior to its use for cloning, the pY75 vector is linearized with NotI, filled in with T4 DNA polymerase and dephosphorylated with shrimp alkaline phosphatase (New England Biolabs, Ipswich, Mass.). Plasmid DNA is then isolated using standard techniques. Restriction digests with EcoRI is conducted to identify plasmid clones in which the start codon is in proximately to the 3'-end of the GPD promoter of pY75 (sense orientation of the ester synthase gene). The plasmid is referred to as pY75_ES.

An empty pY75 vector is used as control. Plasmid DNA of pY75_ES and plasmid DNA of pY75 empty vector are transformed into the *Saccharomyces cerevisiae* strain INVSC1 (Invitrogen, Carlsbad, Calif.) using standard methods such as those described in Gietz et al., *Meth. Enzymol.* 350:87-96 (2002). Recombinant yeast colonies are selected on DOBA media supplemented with CSM-leu (Qbiogene, Carlsbad, Calif.). The cultures are fed with suitable alcohol substrates. The resultant fatty acids and/or fatty acid derivatives are isolated from the host cell using the methods herein. The amount of fatty acids and/or fatty acid derivatives produced is determined using known techniques such as, for example, GC/MS.

Example 20

This example provides an exemplary method for the expression of an ester synthase in a *Yarrowia lipolytica*.

Figure 18:
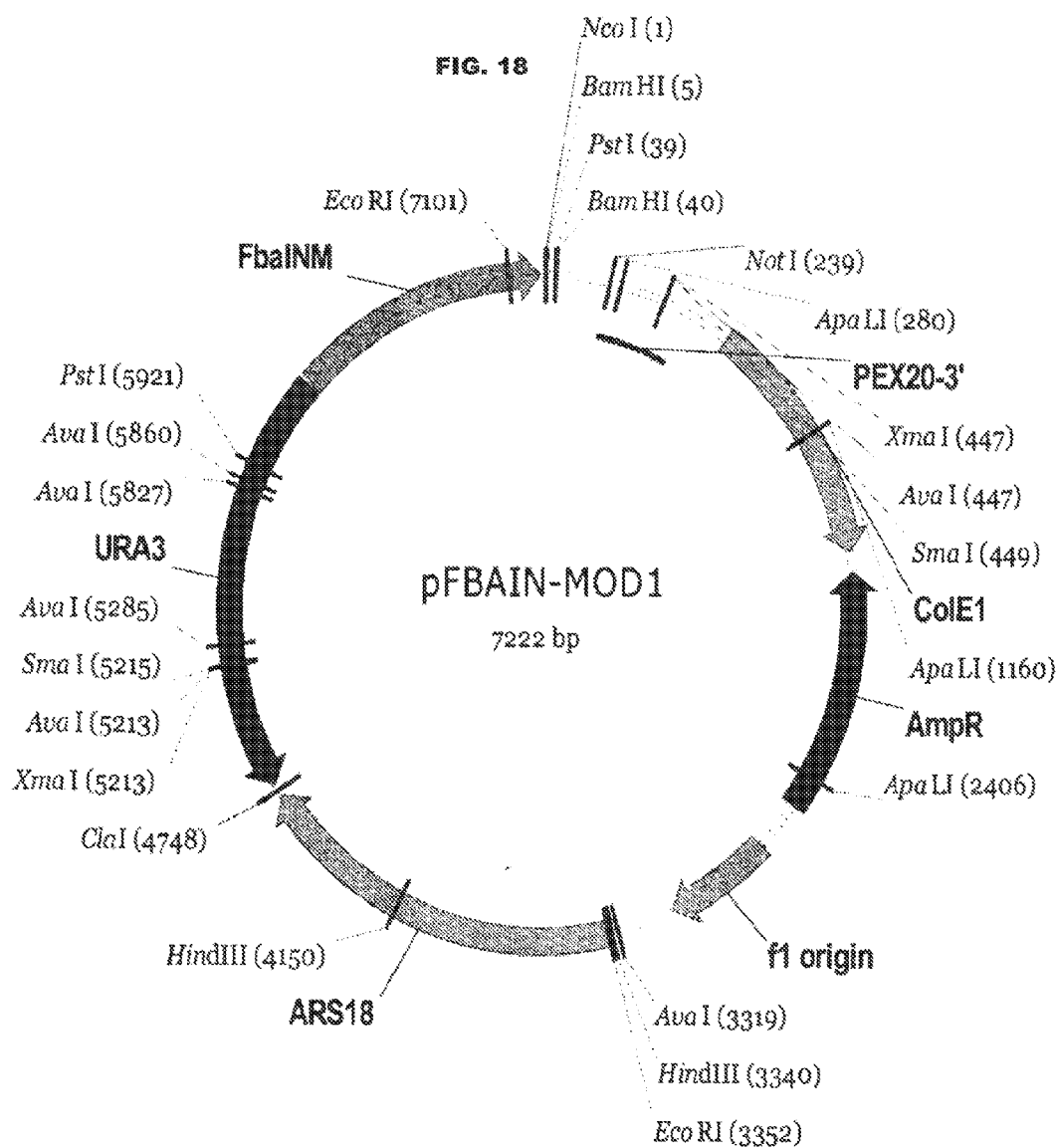
FIG. 18 depicts the features of a pFBAIN-MOD-1 vector, which is useful for carrying out the methods described in Example 20.

A pFBAIN-MOD-1 vector is constructed in accordance with the methods of PCT Publication No. WO2008/147935, the disclosures of which are incorporated by reference herein. A pictorial representation of the features of this vector is presented herein as FIG. 18.

An ester synthase of interest is ligated to the pFBAIN-MOD-1 predigested with NcoI and NotI (SEQ ID NO:51). The ligation reaction contains 10 µL 2× ligation buffer, 1 µL T4 DNA ligase (Promega, Madison, Wis.), 3 µL (~300 ng) of the an ester synthase polynucleotide fragment and 1 µL of pFBAIN-MOD-1 (~150 ng). The reaction mixture is then incubated at room temperature for 2 h and used to transform *E. coli* Top10 Competent cells (Invitrogen, Carlsbad, Calif.). Plasmid DNAs from the transformants are recovered using a Qiagen Miniprep kit (Valencia, Calif.). Correct clones are identified by restriction mapping and the final constructs are designated pFBAIN_ES.

A clone of pFBAIN_ES and a control plasmid pFBAIN-MOD-1 are transformed into a *Yarrowia lipolytica* strain, for example, Y_FOA$^R$. Y_FOA$^R$ is prepared by obtaining *Yarrowia lipolytica* ATCC#20362 cells and plating them on a YPD agar plate (containing 10 g/L of yeast extract (DIFCO Labs, Detroit, Mich.), 20 g/L of bacto pepton (DIFCO), and 20 g/L of glucose). The cells are subsequently streaked onto a Minimum Medium (MM) plate (containing 75 mg/L each of uracil and uridine, 6.7 g/L YNB (yeast nitrogen base) with ammonia sulfate, without amino acids, and 20 g/L glucose) containing 250 mg/L 5-FOA (Zymo Research, Orange, Calif.). Plates can be incubated at 28° C., and the resultant colonies are patched separately onto MM plates containing 200 mg/mL 5-FOA and MM plates lacking uracil and uridine. Ura3 auxotrophy is thus obtained and the resulting strain is the Y_FOA$^R$ strain.

The cells from the transformation are plated onto MM plates lacking uracil (0.17% yeast nitrogen base (DIFCO Labs) without ammonium sulfate or amino acids, 2% glucose, 0.1% proline, pH6.1, 20 g/L agar) and maintained at 30° C. for 2 d. A few transformants are then used to inoculate individual 25 mL cultures in MM medium (0.17% YNB (DIFCO) without ammonium sulfate or amino acids, 2% glucose, 0.1% proline, pH6.1). Each culture is allowed to grow for 2 d at 30° C., then switched to 25 mL HGM (High Glucose Medium containing 80 g/L glucose, 2.58 g/L KH$_2$PO$_4$, 5.36 g/L K$_2$HPO$_4$) and allowed to grow for 5 d at 30° C. The cultures are fed with suitable alcohol substrates.

Total fatty species are then extracted and the production of fatty acids and/or fatty acid derivatives can be ascertained and/or measured using the methods described herein.

Example 21

This example describes the expression of an ester synthase in a cyanobacterial host cell.

Suitable vectors are prepared in order to produce fatty acids and/or derivatives thereof in cyanobacterial host cells including, for example, cells of *Synechococcus* sp. PCC7002, *Synechococcus elongatus* PCC7942, or *Synechocystis* sp. PCC6803. An ester synthase of interest, for example, an atfA 1 (from *A. borkumensis* SK2, GenBank Accession No. YP_694462), AtfA2 (from *A. borkumensis* SK2, GenBank Accession No. YP_693524), ES9 (from *M. hydrocarbonoclasticus* DSM 8789, GenBank Accession No. ABO21021), ES8 (from *M. hydrocarbonoclasticus* DSM 8789, GenBank Accession No. ABO21020), and variants thereof, optionally integrated in the chromosome under the control of a suitable promoter (e.g., PTrc), are then cloned into those vectors.

A vector is constructed to accomplish homologous recombination in *Synechococcus* sp. PCC7002 pAQ1 [GenBank Accession No. NC_0050525] using 500 bp homologous regions corresponding to positions 3301-3800 and 3801-4300. A selectable marker, such as a spectinomycin resistance cassette containing aminoglycoside 3'-adenyltrasnferase gene, aad, a promoter, and a terminator is derived from the plasmid PCL1920 (in accordance with Lerner et al., *Nucleic Acids Res.* 18:4631 (1990)). That selectable marker is inserted into the homologous regions. A plasmid, such as pACYC177, is prepared in accordance with Chang, et al. *J. Bacteria* 134: 1141-1156 (1978). The promoter and ribosome binding site of aminoglycoside phosphotransferase, aph, are added followed by appropriate unique cloning sites that are, for example, NdeI and EcoRI recognition sequences. This complete integration cassette is synthesized and cloned into a pUC19 vector (New England Biolabs, Ipswich, Mass.). The resulting plasmid, pLS9-7002, allows cloning and expression of a foreign gene and delivery and stable in vivo integration into *Synechococcus* sp. PCC7002 pAQ1.

A plasmid or synthetic operon containing an ester synthase gene (e.g., one encoding ES9) is created, and cloned into the NdeI and EcoRI sites of pLS9-7002 downstream of the aph promoter and ribosome binding site. The resultant plasmid is transformed into *Synechococcus* sp. PCC7002 using a method described by Stevens et al., *PNAS* 77:6052-56 (1980).

In some embodiments, another vector is constructed for homologous recombination into the *Synechococcus elongatus* PCC7942 genome (GenBank Accession No. CP_000100) using 800 bp homologous regions corresponding to positions 2577844-2578659 and 2578660-2579467. This chromosomal location is known as neutral site one (NS1) (Mackey et al., *Meth. Mol. Biol.* 362:115-129 (2007). A selectable marker, such as, for example, a spectinomycin resistance cassette is derived and introduced as described above. This integration cassette is synthesized and cloned into pUC19 (New England Biolabs). The resultant plasmid, pLS9-

7942-NS1, allows cloning and expression of a foreign gene and delivery and stable integration into the *Synechococcus elongatus* PCC7942 genome.

A plasmid or synthetic operon comprising an ester synthase gene of interest, is created as described above, which is then cloned into the NdeI or EcoRI site of pLS9-7942-NS1. The resultant plasmid is transformed into *S. elongatus* PCC7942 in accordance with a method described by Mackey et al., supra.

In some embodiments, yet another vector is constructed for homologous recombination into the *Synechocystis* sp. PCC6803 genome (GenBank Accession BA_000022) using 1300 to 1700 by homologous regions corresponding to positions 2299015-2300690, and 2300691-2302056, respectively. This chromosomal location is known as neutral site RS1/2 (Shao et al., *Appl. Environ. Microbiol.* 68:5026-33 (2002)). A plasmid, such as pACYC177, is prepared in accordance with Chang, et al. *J. Bacteriol.* 134: 1141-1156 (1978). As a selectable marker, a kanamycin resistance cassette (containing aminoglycoside phosphotransferase, aph, promoter, gene and terminator) is derived from the pACYC177 plasmid, and it is added between the homologous regions. Additionally, appropriate unique cloning sites, for example, NdeI and XbaI recognitions sites are added. This integration cassette is synthesized and cloned into pUC19 (New England Biolabs). The resultant plasmid, pLS9-6803—$R^S$, allows cloning and expression of a foreign gene and delivery and stable integration into the *Synechocystis* sp. PCC6803 genome.

A plasmid or synthetic operon containing an ester synthase gene is created as described above, which is then cloned into the NdeI or XbaI site of pLS9-6803-RS. The resultant plasmid is transformed into *Synechocystis* sp. PCC6803 in accordance with a method described by Zang et al. *J. Microbiol.*, 45:241-45 (2007).

Other Embodiments

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (160 sequences)

SEQ ID NO: 1 - DNA, 70 bp, Artificial Sequence
  Description of Artificial Sequence: Synthetic primer
aaaaacagcaacaatgtgagctttgttgtaattatattgtaaacatattgattccggggatccgtcgacc

SEQ ID NO: 2 - DNA, 68 bp, Artificial Sequence
  Description of Artificial Sequence: Synthetic primer
aaacggagcctttcggctccgttattcatttacgcggcttcaactttcctgtaggctggagctgcttc

SEQ ID NO: 3 - DNA, 23 bp, Artificial Sequence
  Description of Artificial Sequence: Synthetic primer
cgggcaggtgctatgaccaggac

SEQ ID NO: 4 - DNA, 23 bp, Artificial Sequence
  Description of Artificial Sequence: Synthetic primer
cgcggcgttgaccggcagcctgg

SEQ ID NO: 5 - DNA, 70 bp, Artificial Sequence
  Description of Artificial Sequence: Synthetic primer
atcattctcgtttacgttatcattcactttacatcagagatataccaatgattccggggatccgtcgacc

SEQ ID NO: 6 - DNA, 69 bp, Artificial Sequence
  Description of Artificial Sequence: Synthetic primer
gcacggaaatccgtgccccaaaagagaaattagaaacggaaggttgcggttgtaggctggagctgcttc

SEQ ID NO: 7 - DNA, 21 bp, Artificial Sequence
  Description of Artificial Sequence: Synthetic primer
caacagcaacctgctcagcaa

SEQ ID NO: 8 - DNA, 21 bp, Artificial Sequence
  Description of Artificial Sequence: Synthetic primer
aagctggagcagcaaagcgtt

SEQ ID NO: 9 - DNA, 70 bp, Artificial Sequence
  Description of Artificial Sequence: Synthetic primer
gccgcagcctgatggacaaagcgttcattatggtgctgccggtcgcgatgattccggggatccgtcgacc

SEQ ID NO: 10 - DNA, 65 bp, Artificial Sequence
  Description of Artificial Sequence: Synthetic primer
atcttcaacggtaacttctttaccgccatgcgtgtcccaggtgtctgtaggctggagctgcttcg

SEQ ID NO: 11 - DNA, 71 bp, Artificial Sequence
  Description of Artificial Sequence: Synthetic primer
ctcccctggaatgcaggggagcggcaagattaaaccagttcgttcgggcagtgtaggctggagctgcttcg

SEQ ID NO: 12 - DNA, 74 bp, Artificial Sequence
  Description of Artificial Sequence: Synthetic primer
tatttttagtagcttaaatgtgattcaacatcactggagaaagtcttatgcatatgaatatcctccttagttcc

SEQ ID NO: 13 - DNA, 169 bp, Escherichia coli
gctgtttcagtacactctctcaatacgaataaacggctcagaaatgagccgtttattttttctacccatatccttgaagcggtgttataatgccgcgccctcgatatggggatttttaacgacctgattttcgggtctcagtagtagttgacattagcggagcactaaa

SEQ ID NO: 14 - DNA, 20 bp, Artificial Sequence
  Description of Artificial Sequence: Synthetic primer
ggactaaacgtcctacaaac

SEQ ID NO: 15 - DNA, 20 bp, Artificial Sequence
  Description of Artificial Sequence: Synthetic primer
ttcatctgtttgagatcgag

SEQ ID NO: 16 - DNA, 29 bp, Artificial Sequence
  Description of Artificial Sequence: Synthetic primer
cccgagcggtagccagatgcccgccagcg

SEQ ID NO: 17 - DNA, 29 bp, Artificial Sequence
  Description of Artificial Sequence: Synthetic primer
gctgcgggttagcgcacatcatacgggtc

SEQ ID NO: 18 - protein, 473 aa, Marinobacter hydrocarbonoclasticus
MKRLGTLDASWLAVESEDTPMHVGTLQIFSLPEGAPETFLRDMVTRMKEAGDVAPPWGYKLAWSGFLGRVIAPAWKVDKDIDLDYHVRHSALPRPGGERELGILVSRLHSNPLDFSRPLWECHVIEGLENNRFALYTKMHHSMIDGISGVRLMQRVLTTDPERCNMPPPWTVRPHQRRGAKTDKEASVPAAVSQAMDALKLQADMAPRLWQAGNRLVHSVRHPEDGLTAPFTGPVSVLNHRVTAQRRFATQHYQLDRLKNLAHASGGSLNDIVLYLCGTALRRFLAEQNNLPDTPLTAGIPVNIRPADDEGTGTQISFMIASLATDEADPLNRLQQIKTSTRRAKEHLQKLPKSALTQYTMLLMSPYILQLMSGLGGRMRPVFNVTISNVPGPEGTLYYEGARLEAMYPVSLIAHGGALNITCLSYAGSLNFGFTGCRDTLPSMQKLAVYTGEALDELESLILPPKKRARTRK

SEQ ID NO: 19 - DNA, 71 bp, Artificial Sequence
  Description of Artificial Sequence: Synthetic primer
taaccggcgtctgacgactgacttaacgctcaggctttattgtccactttgtgtaggctggagctgcttcg

SEQ ID NO: 20 - DNA, 74 bp, Artificial Sequence
  Description of Artificial Sequence: Synthetic primer
atttggggttgcgatgacgacgaacacgcattttagaggtgaagaattgcatatgaatatcctcctttagttcc

SEQ ID NO: 21 - DNA, 20 bp, Artificial Sequence
  Description of Artificial Sequence: Synthetic primer
cgtccgtggtaatcatttgg

SEQ ID NO: 22 - DNA, 5199 bp, Artificial Sequence
  Description of Artificial Sequence: Synthetic polynucleotide
cactataccaattgagatgggctagtcaatgataattactagtccttttcctttgagttgtgggtatctgtaaattctgctagacctttgctggaaaacttgtaaattctgctagaccctctgtaaattccgctagacctttgtgtgttttttttgtttatattcaagtggttataatttatagaataaagaaagaataaaaaaagataaaaagaatagatcccagccctgtgtataactcactactttagtcagttccgcagtattacaaaaggatgtcgcaaacgctgtttcagtacactctctcaatacgaataaacggctcagaaatgagccgtttattttttctacccatatccttgaagcggtgttataatgccgcgccctcgatatggggatttttaacgacctgattttcgggtctcagtagtagttgacattagcggagcactaaaccatgaaacgtctcggaaccctggacgcctcctggctggcggttgaatctgaagacaccccgatgcatgtgggtacgcttcagattttctcactgccggaaggcgcaccagaaaccttcctgcgtgacatggtcactcgaatgaaagaggccggcgatgtggcaccaccctggggatacaaactggcctggtctggtttcctcgggcgcgtgatcgccccggcctggaaagtcgataaggatatcgatctggattatcacgtccggcactcagccctgcctcgccccggcggggagcgcgaactgggtattctggtatcccgactgcactctaaccccctggatttttcccgccctctttgggaatgccacgttattgaaggcctggagaataaccgttttgccctttacaccaaaatgcaccactcgatgattgacggcatcagcggcgtgcgactgatgcagagggtgctcaccaccgatcccgaacgctgcaatatgccaccgccctggacggtacgcccacaccaacgccgtggtgcaaaaaccgacaaagaggccagcgtgcccgcagcggtttcccaggcaatggacgccctgaagctccaggcagacatggcccccaggctgtggcaggccggcaatcgcctggtgcattcggttcgacacccggaagacggactgaccgcgcccttcactggaccggtttcggtgctcaatcaccgggttaccgcgcagcgacgttttgccacccagcattatcaactggaccggctgaaaaacctggcccatgcttccggcggttccttgaacgacatcgtgctttacctgtgtggcaccgcattgcggcgctttctggctgagcagaacaatctgccagacaccccgctgacggctggtataccggtgaatatccggccggcagacgacgagggtacgggcacccagatcagttttatgattgcctcgctggccaccgacgaagctgatccgttgaaccgcctgcaacagatcaaaacctcgacccgacgggccaaggagcacctgcagaaacttccaaaaagtgccctgacccagtacaccatgctgctgatgtcaccctacattctgcaattgatgtcaggtctcggggggaggatgcgaccagtcttcaacgtgaccatttccaacgtgcccggcccggaaggcacgctgtattatgaaggagcccggcttgaggccatgtatccggtatcgctaatcgctcacggcggcgccctgaacatcacctgcctgagctatgccggatcgctgaatttcggttttaccggctgtcgggatacgctgccgagcatgcagaaactggcggtttataccggtgaagctctggatgagctggaatcgctgattctgccacccaagaagcgcgcccgaacccgcaagtaactcgagatctgcagctggtaccatatgggaattcacccgctgacgagcttagtaaagccctcgctagattttaatgcggatgttgcgattacttcgccaactattgcgataacaagaaaaagccagcctttcatgatatatctcccaatttgtgtagggcttattatgcacgcttaaaaataataaaagcagacttgacctgatagtttggctgtgagcaattatgtgcttagtgcatctaacgcttgagttaagccgcgccgcgaagcggcgtcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactttgttttagggcgactgccctgctgcgtaacatcgttgctgctccataacatcaaacatcgacccacggcgtaacgcgcttgctgcttggatgcccgaggcatagactgtaccccaaaaaaacagtcataacaagccatgaaaaccgccactgcgccgttaccaccgctgcgttcggtcaaggttctggaccagttgcgtgagcgcatacgctacttgcattacagcttacgaaccgaacaggcttatgtccactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccagcttctgtatggaacgggcatgcggatcagtgagggtttgcaactgcgggtcaaggatctggatttcgatcacggcacgatcatcgtgcgggagggcaagggctccaaggatcgggccttgatgttacccgagagcttggcacccagcctgcgcgagcaggggaattaattcccacgggttttgctgcccgcaaacgggctgttctggtgttgctagtttgttatcagaatcgcagatccggcttcagccggtttgccggctgaaagcgctatttcttccagaattgccatgattttttccccacgggaggcgtcactggctcccgtgttgtcggcagctttgattcgataagcagcatcgcctgtttcaggctgtctatgtgtgactgttgagctgtaacaagttgtctcaggtgttcaatttcatgttctagttgctttgttttactggtttcacctgttctattaggtgttacatgctgttcatctgttacattgtcgatctgttcatggtgaacagctttgaatgcaccaaaaactcgtaaaagctctgatgtatctatcttttttacaccgttttcatctgtgcatatggacagttttccctttgatatgtaacggtgaacagttgttctacttttgtttgttagtcttgatgcttcactgatagatacaagagccataagaacctcagatccttccgtatttagccagtatgttctctagtgtggttcgttgtttttgcgtgagccatgagaacgaaccattgagatcatacttactttgcatgtcactcaaaaattttgcctcaaaactggtgagctgaatttttgcagttaaagcatcgtgtagtgtttttcttagtccgttatgtaggtaggaatctgatgtaatggttgttggtattttgtcaccattcatttttatctggttgttctcaagttcggttacgagatccatttgtctatctagttcaacttggaaaatcaacgtatcagtcgggcggcctcgcttatcaaccaccaatttcatattgctgtaagtgtttaaatctttacttattggtttcaaaacccattggttaagccttttaaactcatggtagttattttcaagcattaacatgaacttaaattcatcaaggctaatctctatatttgccttgtgagttttcttttgtgttagttcttttaataaccactcataaatcctcatagagtatttgttttcaaaagacttaacatgttccagattatattttatgaatttttttaactggaaaagataaggcaatatctcttcactaaaaactaattctaatttttcgcttgagaacttggcatagtttgtccactggaaaatctcaaagcctttaaccaaaggattcctgatttccacagttctcgtcatcagctctctggttgctttagctaatacaccataagcattttccctactgatgttcatcatctgagcgtattggttataagtgaacgataccgtccgttctttccttgtagggttttcaatcgtggggttgagtagtgccacacagcataaaattagcttggtttcatgctccgttaagtcatagcgactaatcgctagttcatttgctttgaaaacaactaattcagacatacatctcaattggtctaggtgattttaat

SEQ ID NO: 23 - DNA, 7314 bp, Artificial Sequence
  Description of Artificial Sequence: Synthetic polynucleotide
cactataccaattgagatgggctagtcaatgataattactagtccttttcctttgagttgtgggtatctgtaaattctgctagacctttgctggaaaacttgtaaattctgctagaccctctgtaaattccgctagacctttgtgtgttttttttgtttatattcaagtggttataatttatagaataaagaaagaataaaaaaagataaaaagaatagatcccagccctgtgtataactcactactttagtcagttccgcagtattacaaaaggatgtcgcaaacgctgtttgctcctctacaaaacagaccttaaaaccctaaaggcgtcggcatccgcttacagacaagctgtgaccgtctccgggagctgcatgtgtcagaggttttcaccgtcatcaccgaaacgcgcgaggcagcagatcaattcgcgcgcgaaggcgaagcggcatgcatttacgttgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgttaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgatctggtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagcgccgctgagaaaaagcgaagcggcactgctctttaacaatttatcagacaatctgtgtgggcactcgaccggaattatcgattaactttattattaaaaattaaagaggtatatattaatgtatcgattaaataaggaggaataaaccatgaaacgtctcggaaccctggacgcctcctggctggcggttgaatctgaagacaccccgatgcatgtgggtacgcttcagattttctcactgccggaaggcgcaccagaaaccttcctgcgtgacatggtcactcgaatgaaagaggccggcgatgtggcaccaccctggggatacaaactggcctggtctggtttcctcgggcgcgtgatcgccccggcctggaaagtcgataaggatatcgatctggattatcacgtccggcactcagccctgcctcgccccggcggggagcgcgaactgggtattctggtatcccgactgcactctaaccccctggatttttcccgccctctttgggaatgccacgttattgaaggcctggagaataaccgttttgccctttacaccaaaatgcaccactcgatgattgacggcatcagcggcgtgcgactgatgcagagggtgctcaccaccgatcccgaacgctgcaatatgccaccgccctggacggtacgcccacaccaacgccgtggtgcaaaaaccgacaaagaggccagcgtgcccgcagcggtttcccaggcaatggacgccctgaagctccaggcagacatggcccccaggctgtggcaggccggcaatcgcctggtgcattcggttcgacacccggaagacggactgaccgcgcccttcactggaccggtttcggtgctcaatcaccgggttaccgcgcagcgacgttttgccacccagcattatcaactggaccggctgaaaaacctggcccatgcttccggcggttccttgaacgacatcgtgctttacctgtgtggcaccgcattgcggcgctttctggctgagcagaacaatctgccagacaccccgctgacggctggtataccggtgaatatccggccggcagacgacgagggtacgggcacccagatcagttttatgattgcctcgctggccaccgacgaagctgatccgttgaaccgcctgcaacagatcaaaacctcgacccgacgggccaaggagcacctgcagaaacttccaaaaagtgccctgacccagtacaccatgctgctgatgtcaccctacattctgcaattgatgtcaggtctcggggggaggatgcgaccagtcttcaacgtgaccatttccaacgtgcccggcccggaaggcacgctgtattatgaaggagcccggcttgaggccatgtatccggtatcgctaatcgctcacggcggcgccctgaacatcacctgcctgagctatgccggatcgctgaatttcggttttaccggctgtcgggatacgctgccgagcatgcagaaactggcggtttataccggtgaagctctggatgagctggaatcgctgattctgccacccaagaagcgcgcccgaacccgcaagtaactcgagatctgcagctggtaccatatgggaattcgaagcttgggcccgaacaaaaactcatctcagaagaggatctgaatagcgccgtcgaccatcatcatcatcatcattgagtttaaacggtctccagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgacgcctgatgcggtattttctccttacgcatctgtgcggtatttcacaccgcatatggtgcactctcagtacaatctgctctgatgccgcatagttaagccagccccgacacccgccaacacccgctgacgagcttagtaaagccctcgctagattttaatgcggatgttgcgattacttcgccaactattgcgataacaagaaaaagccagcctttcatgatatatctcccaatttgtgtagggcttattatgcacgcttaaaaataataaaagcagacttgacctgatagtttggctgtgagcaattatgtgcttagtgcatctaacgcttgagttaagccgcgccgcgaagcggcgtcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactttgttttagggcgactgccctgctgcgtaacatcgttgctgctccataacatcaaacatcgacccacggcgtaacgcgcttgctgcttggatgcccgaggcatagactgtaccccaaaaaaacagtcataacaagccatgaaaaccgccactgcgccgttaccaccgctgcgttcggtcaaggttctggaccagttgcgtgagcgcatacgctacttgcattacagcttacgaaccgaacaggcttatgtccactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccagcttctgtatggaacgggcatgcggatcagtgagggtttgcaactgcgggtcaaggatctggatttcgatcacggcacgatcatcgtgcgggagggcaagggctccaaggatcgggccttgatgttacccgagagcttggcacccagcctgcgcgagcaggggaattaattcccacgggttttgctgcccgcaaacgggctgttctggtgttgctagtttgttatcagaatcgcagatccggcttcagccggtttgccggctgaaagcgctatttcttccagaattgccatgattttttccccacgggaggcgtcactggctcccgtgttgtcggcagctttgattcgataagcagcatcgcctgtttcaggctgtctatgtgtgactgttgagctgtaacaagttgtctcaggtgttcaatttcatgttctagttgctttgttttactggtttcacctgttctattaggtgttacatgctgttcatctgttacattgtcgatctgttcatggtgaacagctttgaatgcaccaaaaactcgtaaaagctctgatgtatctatcttttttacaccgttttcatctgtgcatatggacagttttccctttgatatgtaacggtgaacagttgttctacttttgtttgttagtcttgatgcttcactgatagatacaagagccataagaacctcagatccttccgtatttagccagtatgttctctagtgtggttcgttgtttttgcgtgagccatgagaacgaaccattgagatcatacttactttgcatgtcactcaaaaattttgcctcaaaactggtgagctgaatttttgcagttaaagcatcgtgtagtgtttttcttagtccgttatgtaggtaggaatctgatgtaatggttgttggtattttgtcaccattcatttttatctggttgttctcaagttcggttacgagatccatttgtctatctagttcaacttggaaaatcaacgtatcagtcgggcggcctcgcttatcaaccaccaatttcatattgctgtaagtgtttaaatctttacttattggtttcaaaacccattggttaagccttttaaactcatggtagttattttcaagcattaacatgaacttaaattcatcaaggctaatctctatatttgccttgtgagttttcttttgtgttagttcttttaataaccactcataaatcctcatagagtatttgttttcaaaagacttaacatgttccagattatattttatgaatttttttaactggaaaagataaggcaatatctcttcactaaaaactaattctaatttttcgcttgagaacttggcatagtttgtccactggaaaatctcaaagcctttaaccaaaggattcctgatttccacagttctcgtcatcagctctctggttgctttagctaatacaccataagcattttccctactgatgttcatcatctgagcgtattggttataagtgaacgataccgtccgttctttccttgtagggttttcaatcgtggggttgagtagtgccacacagcataaaattagcttggtttcatgctccgttaagtcatagcgactaatcgctagttcatttgctttgaaaacaactaattcagacatacatctcaattggtctaggtgattttaat

SEQ ID NO: 24 - protein, 455 aa, Marinobacter hydrocarbonoclasticus
MTPLNPTDQLFLWLEKRQQPMHVGGLQLFSFPEGAPDDYVAQLADQLRQKTEVTAPFNQRLSYRLGQPVWVEDEHLDLEHHFRFEALPTPGRIRELLSFVSAEHSHLMDRERPMWEVHLIEGLKDRQFALYTKVHHSLVDGVSAMRMATRMLSENPDEHGMPPIWDLPCLSRDRGESDGHSLWRSVTHLLGLSDRQLGTIPTVAKELLKTINQARKDPAYDSIFHAPRCMLNQKITGSRRFAAQSWCLKRIRAVCEAYGTTVNDVVTAMCAAALRTYLMNQDALPEKPLVAFVPVSLRRDDSSGGNQVGVILASLHTDVQDAGERLLKIHHGMEEAKQRYRHMSPEEIVNYTALTLAPAAFHLLTGLAPKWQTFNVVISNVPGPSRPLYWNGAKLEGMYPVSIDMDRLALNMTLTSYNDQVEFGLIGCRRTLPSLQRMLDYLEQGLAELELNAGL

SEQ ID NO: 25 - protein, 457 aa, Alcanivorax borkumensis
MKALSPVDQLFLWLEKRQQPMHVGGLQLFSFPEGAGPKYVSELAQQMRDYCHPVAPFNQRLTRRLGQYYWTRDKQFDIDHHFRHEALPKPGRIRELLSLVSAEHSNLLDRERPMWEAHLIEGIRGRQFALYYKIHHSVMDGISAMRIASKTLSTDPSEREMAPAWAFNTKKRSRSLPSNPVDMASSMARLTASISKQAATVPGLAREVYKVTQKAKKDENYVSIFQAPDTILNNTITGSRRFAAQSFPLPRLKVIAKAYNCTINTVVLSMCGHALREYLISQHALPDEPLIAMVPMSLRQDDSTGGNQIGMILANLGTHICDPANRLRVIHDSVEEAKSRFSQMSPEEILNFTALTMAPTGLNLLTGLAPKWRAFNVVISNIPGPKEPLYWNGAQLQGVYPVSIALDRIALNITLTSYVDQMEFGLIACRRTLPSMQRLLDYLEQSIRELEIGAGIK

SEQ ID NO: 26 - protein, 451 aa, Alcanivorax borkumensis
MARKLSIMDSGWLMMETRETPMHVGGLALFAIPEGAPEDYVESIYRYLVDVDSICRPFNQKIQSHLPLYLDATWVEDKNFDIDYHVRHSALPRPGRVRELLALVSRLHAQRLDPSRPLWESYLIEGLEGNRFALYTKMHHSMVDGVAGMHLMQSRLATCAEDRLPAPWSGEWDAEKKPRKSRGAAAANAGMKGTMNNLRRGGGQLVDLLRQPKDGNVKTIYRAPKTQLNRRVTGARRFAAQSWSLSRIKAAGKQHGGTVNDIFLAMCGGALRRYLLSQDALSDQPLVAQVPVALRSADQAGEGGNAITTVQVSLGTHIAQPLNRLAAIQDSMKAVKSRLGDMQKSEIDVYTVLTNMPLSLGQVTGLSGRVSPMFNLVISNVPGPKETLHLNGAEMLATYPVSLVLHGYALNITVVSYKNSLEFGVIGCRDTLPHIQRFLVYLEESLVELEP

SEQ ID NO: 27 - DNA, 1422 bp, Marinobacter hydrocarbonoclasticus
atgaaacgtctcggaaccctggacgcctcctggctggcggttgaatctgaagacaccccgatgcatgtgggtacgcttcagattttctcactgccggaaggcgcaccagaaaccttcctgcgtgacatggtcactcgaatgaaagaggccggcgatgtggcaccaccctggggatacaaactggcctggtctggtttcctcgggcgcgtgatcgccccggcctggaaagtcgataaggatatcgatctggattatcacgtccggcactcagccctgcctcgccccggcggggagcgcgaactgggtattctggtatcccgactgcactctaaccccctggatttttcccgccctctttgggaatgccacgttattgaaggcctggagaataaccgttttgccctttacaccaaaatgcaccactcgatgattgacggcatcagcggcgtgcgactgatgcagagggtgctcaccaccgatcccgaacgctgcaatatgccaccgccctggacggtacgcccacaccaacgccgtggtgcaaaaaccgacaaagaggccagcgtgcccgcagcggtttcccaggccatggacgccctgaagctccaggcagacatggcccccaggctgtggcaggccggcaatcgcctggtgcattcggttcgacacccggaagacggactgaccgcgcccttcactggaccggtttcggtgctcaatcaccgggttaccgcgcagcgacgttttgccacccagcattatcaactggaccggctgaaaaacctggcccatgcttccggcggttccttgaacgacatcgtgctttacctgtgtggcaccgcattgcggcgctttctggctgagcagaacaatctgccagacaccccgctgacggctggtataccggtgaatatccggccggcagacgacgagggtacgggcacccagatcagtttcatgattgcctcgctggccaccgacgaagctgatccgttgaaccgcctgcaacagatcaaaacctcgacccgacgggccaaggagcacctgcagaaacttccaaaaagtgccctgacccagtacaccatgctgctgatgtcaccctacattctgcaattgatgtcaggtctcggggggaggatgcgaccagtcttcaacgtgaccatttccaacgtgcccggcccggaaggcacgctgtattatgaaggagcccggcttgaggccatgtatccggtatcgctaatcgctcacggcggcgccctgaacatcacctgcctgagctatgccggatcgctgaatttcggttttaccggctgtcgggatacgctgccgagcatgcagaaactggcggtttataccggtgaagctctggatgagctggaatcgctgattctgccacccaagaagcgcgcccgaacccgcaagtaa

SEQ ID NO: 28 - DNA, 1368 bp, Marinobacter hydrocarbonoclasticus
atgacgcccctgaatcccactgaccagctctttctctggctggaaaaacgccagcagcccatgcatgtgggcggcctccagctgttttccttccccgaaggcgcgccggacgactatgtcgcgcagctggcagaccagcttcggcagaagacggaggtgaccgccccctttaaccagcgcctgagctatcgcctgggccagccggtatgggtggaggatgagcacctggaccttgagcatcatttccgcttcgaggcgctgcccacacccgggcgtattcgggagctgctgtcgttcgtatcggcggagcattcgcacctgatggaccgggagcgccccatgtgggaggtgcacctgatcgagggcctgaaagaccggcagtttgcgctctacaccaaggttcaccattccctggtggacggtgtctcggccatgcgcatggccacccggatgctgagtgaaaacccggacgaacacggcatgccgccaatctgggatctgccttgcctgtcacgggataggggtgagtcggacggacactccctctggcgcagtgtcacccatttgctggggctttcggaccgccagctcggcaccattcccactgtggcaaaggagctactgaaaaccatcaatcaggcccggaaggatccggcctacgactccattttccatgccccgcgctgcatgctgaaccagaaaatcaccggttcccgtcgattcgccgctcagtcctggtgcctgaaacggattcgcgccgtatgcgaggcctacggcaccacggtcaacgatgtcgtgactgccatgtgcgcagcggctctgcgtacctatctgatgaatcaggatgccttgccggagaaaccactggtggcctttgtgccggtgtcgctacgccgggacgacagctccggcggcaaccaggtaggcgtcatcctggcgagccttcacaccgatgtgcaggacgccggcgaacgactgttaaaaattcaccacggcatggaagaggccaagcagcgctaccggcatatgagcccggaggaaatcgtcaactacacggccctgaccctggcgccggccgccttccacctgctgaccgggctggcgcccaagtggcagaccttcaatgtggtgatttccaatgtccccgggccatccaggcccctgtactggaacggggcgaaactggaaggcatgtatccggtgtctatcgatatggacaggctggccctgaacatgacactgaccagctataacgaccaggtggagttcggcctgattggctgtcgccggaccctgcccagcctgcaacggatgctggactacctggaacagggtctggcagagctggagctcaacgccggtctgtaa

SEQ ID NO: 29 - DNA, 1374 bp, Alcanivorax borkumensis
atgaaagcgcttagcccagtggatcaactgttcctgtggctggaaaaacgacagcaacccatgcacgtaggcggtttgcagctgttttccttcccggaaggtgccggccccaagtatgtgagtgagctggcccagcaaatgcgggattactgccacccagtggcgccattcaaccagcgcctgacccgtcgactcggccagtattactggactagagacaaacagttcgatatcgaccaccacttccgccacgaagcactccccaaacccggtcgcattcgcgaactgctttctttggtctccgccgaacattccaacctgctggaccgggagcgccccatgtgggaagcccatttgatcgaagggatccgcggtcgccagttcgctctctattataagatccaccattcggtgatggatggcatatccgccatgcgtatcgcctccaaaacgctttccactgaccccagtgaacgtgaaatggctccggcttgggcgttcaacaccaaaaaacgctcccgctcactgcccagcaacccggttgacatggcctccagcatggcgcgcctaaccgcgagcataagcaaacaagctgccacagtgcccggtctcgcgcgggaggtttacaaagtcacccaaaaagccaaaaaagatgaaaactatgtgtctatttttcaggctcccgacacgattctgaataataccatcaccggttcacgccgctttgccgcccagagctttccattaccgcgcctgaaagttatcgccaaggcctataactgcaccattaacaccgtggtgctctccatgtgtggccacgctctgcgcgaatacttgattagccaacacgcgctgcccgatgagccactgattgccatggtgcccatgagcctgcggcaggacgacagcactggcggcaaccagatcggtatgatcttggctaacctgggcacccacatctgtgatccagctaatcgcctgcgcgtcatccacgattccgtcgaggaagccaaatcccgcttctcgcagatgagcccggaagaaattctcaatttcaccgccctcaccatggctcccaccggcttgaacttactgaccggcctagcgccaaaatggcgggccttcaacgtggtgatttccaacatacccgggccgaaagagccgctgtactggaatggtgcacagctgcaaggagtgtatccagtatccattgccttggatcgcatcgccctaaatatcaccctcaccagttatgtagaccagatggaatttgggcttatcgcctgccgccgtactctgccttccatgcagcgactactggattacctggaacagtccatccgcgaattggaaatcggtgcaggaattaaatag

SEQ ID NO: 30 - DNA, 1356 bp, Alcanivorax borkumensis
atggcccgtaaattgtctattatggattccggctggttaatgatggagacccgggaaacccctatgcatgtgggggggttggcgttgtttgccattccagaaggtgctcctgaggattatgtggaaagtatctatcgatacctggtggatgtggatagcatctgccgcccatttaaccaaaagattcagtctcatttgcccctgtacttagatgctacttgggtggaagacaaaaatttcgatattgactaccacgtacggcattctgccttgcctcggccgggacgggtgcgtgagctgttggcgttagtatcgcggttgcacgcccagcgtttggatcctagccgcccgttgtgggagagctatttgatcgaggggttggagggaaaccgtttcgctctttataccaagatgcatcactccatggtggatggggtggcagggatgcacctaatgcagtctcgcctagctacttgtgcggaagaccgtttacccgccccttggtctggcgagtgggatgcagagaagaaaccgagaaagagccgtggcgctgcagcggcgaatgccggtatgaaaggaacaatgaataacctgcgccgaggtggtggtcagcttgtggacctgctgcgacagcccaaggatggcaacgtaaagactatctatcgggcgccgaaaacccagctaaaccgccgggtgacgggcgcgcgacgctttgctgcccagtcgtggtcgctgtcgcggattaaagccgcgggcaaacagcatggcggtacggtgaatgatattttccttgccatgtgtggcggcgcgctgcgtcgctatctgctcagtcaggatgccttgtccgatcagccgttggtagcccaggtgccagtagccttgcgtagtgcggatcaggctggtgagggtggcaatgccattactacggttcaggtaagcctgggtacgcatattgctcagccgctgaatcggctggccgcaatccaggattccatgaaagcggtgaaatctcggcttggtgatatgcagaagtccgagatcgatgtttatacggtgctgaccaatatgccgctgtctttggggcaggtcacgggcctgtccgggcgcgtaagccccatgtttaacctagtgatttccaatgtgccggggccgaaggaaacgcttcatctcaatggtgcggagatgttggctacctatccggtgtcattggttctgcatggttacgccctaaatatcactgtggtgagctacaagaatagccttgagtttggcgtgatcggttgccgtgacacgttgcctcatattcagcgttttctggtttatctcgaagaatcgctggtggagctggagccttga

SEQ ID NO: 31 - DNA, 18 bp, Artificial Sequence
  Description of Artificial Sequence: Synthetic primer
tcgcaaccttttcgttgg

SEQ ID NO: 32 - DNA, 42 bp, Artificial Sequence
  Description of Artificial Sequence: Synthetic primer
aaaggatgtcgcaaacgctgtttcagtacactctctcaatac

SEQ ID NO: 33 - DNA, 34 bp, Artificial Sequence
  Description of Artificial Sequence: Synthetic primer
gagctcggatccatggtttagtgctccgctaatg

SEQ ID NO: 34 - DNA, 25 bp, Artificial Sequence
  Description of Artificial Sequence: Synthetic primer
gaattccacccgctgacgagcttag

SEQ ID NO: 35 - DNA, 21 bp, Artificial Sequence
  Description of Artificial Sequence: Synthetic primer
cgaattcccatatggtaccag

SEQ ID NO: 36 - DNA, 30 bp, Artificial Sequence
  Description of Artificial Sequence: Synthetic primer
cccagatcagttttatgattgcctcgctgg

SEQ ID NO: 37 - DNA, 20 bp, Artificial Sequence
  Description of Artificial Sequence: Synthetic primer
atcatgaaacgtctcggaac

SEQ ID NO: 38 - DNA, 28 bp, Artificial Sequence
  Description of Artificial Sequence: Synthetic primer
cctcgagttacttgcgggttcgggcgcg

SEQ ID NO: 39 - protein, 485 aa, Marinobacter algicola
MKRLGTLDASWLAVESEDTPMHVGNLQIFSLPEDAPETFLRDMLARMKADADVAPPWCYKLAFSGFLGRLVAPSWKVDKKLDLDYHVRHSALPRPGSERELGILVSRLHSNPLDFSRPLWECHIIEGLENNRFALYTKMHHSMIDGISGVRLMQRVLSEDPGEINMLPPWSVRPERTRGSKTDSEASISAALSQAMEALRIQADMAPRLWNAMNRLIQSARHPEEGLTAPFAGPVSALNHRVTGQRRFATQHYQLERIKQVAQASNGSLNDIVLYLCGTALRRFLVEQDGLPDTPLTAGIPVNIRPSDDQGTGTQISFMIASLATDEADPLKRLKSIKHSTRRAKQHLQKLPRKALTQYTMLLMSPYILQLMSGLGGRMRPVFNVTISNVPGPGETLYYEGARLEAMYPVSLIAHGGALNITCLSYAGSLNFGFTGCRDTLPSMQKLAVYTGEALDELESLVSPPPNQTKTNARKAPRKKTAEKS

SEQ ID NO: 40 - DNA, 1458 bp, Artificial Sequence
  Description of Artificial Sequence: Synthetic polynucleotide
atgaaacgtctgggcactctggatgcttcttggttggccgtggaaagcgaggacacgccgatgcacgttggcaacctgcagattttcagcctgccggaggacgcaccggaaacgttcctgcgcgacatgctggcccgcatgaaagcagacgcggacgtggcaccgccttggtgttacaaactggcgtttagcggttttctgggccgtctggtggcgccaagctggaaagtggataagaagctggatctggactatcatgttcgccatagcgcattgccgcgtccgggcagcgaacgtgagctgggtattctggtgagccgcctgcatagcaatccgctggacttttcccgtccgctgtgggaatgccacattatcgagggcttggaaaacaaccgtttcgcactgtataccaaaatgcaccacagcatgattgacggtatcagcggtgtccgtctgatgcagcgtgtgctgagcgaagatccgggtgagatcaatatgctgccgccgtggagcgttcgcccggagcgtacccgtggttccaaaaccgatagcgaagcgagcatctctgcagcactgtcccaagcaatggaggcgctgcgcattcaagcagatatggctccgcgcctgtggaatgcgatgaatcgtctgattcaaagcgcgcgtcatccagaagaaggtttgactgcgccgttcgccggtccggtttctgccctgaaccaccgcgttacgggtcagcgccgttttgcaacccaacactatcagctggagcgcatcaagcaggtggcgcaggcgagcaatggctccctgaatgacatcgtcttgtatctgtgcggcaccgcattgcgtcgctttctggttgaacaagacggtttgccggataccccactgaccgcaggcatcccggtgaacattcgtccgagcgacgaccaaggtacgggcacgcaaatcagctttatgattgcctccctggcgaccgatgaggcggatcctctgaagcgtctgaagtcgatcaagcacagcacccgtcgtgccaaacagcatctgcagaagctgccgcgtaaggcgctgacgcaatacacgatgctgttgatgagcccgtacatcctgcaactgatgagcggtttgggcggtcgcatgcgtccggtctttaacgttacgatctccaacgtccctggtccaggcgaaaccctgtactatgaaggtgcgcgcctggaggcgatgtatccggtcagcctgattgcgcacggtggcgcgttgaacattacctgtctgagctacgctggtagcctgaatttcggtttcactggctgccgcgatacgctgccgtcgatgcagaaattggccgtctacaccggtgaggccctggatgagctggagagcctggtttctccaccgcctaaccagaccaagaccaatgcgcgtaaagctccgcgtaagaaaacggctgagaaaagctaa

SEQ ID NO: 41 - protein, 508 aa, Limnobacter sp.
MARNIPLLDASWLYVESKEAPMHVGSMAIFTVPEGETSQQAIARIVQMLRNSLEFAPPFNYRLSSPRLLTLMPKWIEADKIDLDYHFRHSALPAPGGERELGTLISRLHSHPLDFRKPLWEMHLIEGLYGNRFALYTKMHHSLMDGVGGMRLMERIFGKSAKESMNLPAPWSVGTISRKKKNSEPQHFADQAREAWEAAKLSGQSLPAAGRALMDLMREAVKPTDPALATPFSGPKSIVNKRVGGARRLATQTYPLERVRAVAEAAKVSVNDIFLAICSSSIRRYLLERDALPSESLTAGLPVSVRPADDLDGGNAISFIIANLYTTEADPLTRLKEIRRSTQLAKANLQAMPKEAINNYTIMLMAPMMLQLVSGLGGLTRPIFNTVISNVPGPSRDLYFSGCRLEQFYPISLIPHGQALNITVVSYSGQFNVAFTGDHDALPSMQRLSVYTGEALEELEAALGVKWASKPVVKPVTEKRPVAAKKPAVRKPATAKVGAGKPVKAPED

SEQ ID NO: 42 - DNA, 1527 bp, Artificial Sequence
  Description of Artificial Sequence: Synthetic polynucleotide
atggcccgcaatatccctctgttggatgcgagctggctgtatgtcgaaagcaaagaggcaccgatgcacgtcggtagcatggcgatcttcacggtgccagagggcgaaacgagccaacaggcaattgcgcgcattgtgcagatgctgcgtaactctctggagtttgcaccgccgtttaactaccgtctgtccagcccacgcctgctgaccctgatgccgaaatggatcgaagccgataagattgacttggactaccactttcgccatagcgcgctgccggctccgggtggcgaacgtgagctgggtaccctgattagccgtttgcacagccacccgttggactttcgtaaacctctgtgggagatgcacctgattgagggtctgtatggcaatcgttttgcgttgtacacgaagatgcatcacagcttgatggacggtgttggtggcatgcgtctgatggagcgtatcttcggcaaatctgccaaagaaagcatgaatctgccagcaccttggagcgttggcaccatcagccgcaagaagaaaaactccgaaccgcaacatttcgcagatcaagcgcgtgaggcgtgggaagccgcgaaactgtcgggccagtccctgccagcggctggccgtgcgctgatggatttgatgcgcgaagccgtgaagccgacggatccggccctggcaacgccgttcagcggtccgaaatccatcgtcaacaagcgtgttggcggtgcgcgtcgcctggcgacccagacctacccgctggaacgtgtgcgtgctgttgcggaggccgcgaaggtgagcgttaacgacattttcctggctatttgcagctcttctattcgtcgttacctgctggaacgcgatgccttgccgagcgagtctctgaccgctggtctgcctgtgagcgtccgtcctgctgatgatctggacggtggcaatgcgattagctttatcattgccaatctgtatacgaccgaggcggacccgctgacccgcctgaaagaaatccgccgtagcactcaactggcgaaggcgaacctgcaagcaatgccgaaagaggcaatcaacaattacacgatcatgctgatggccccgatgatgctgcaactggtcagcggcctgggtggtctgacccgtccgatcttcaacaccgttatctccaacgtgccgggtccgagccgtgacttgtatttctcgggttgtcgtctggaacagttctatccgattagcctgattccgcacggtcaggcgctgaatatcaccgttgtcagctatagcggtcagtttaacgtcgcgttcaccggcgaccacgatgcactgccgagcatgcagcgtctgtccgtgtacaccggtgaggccctggaagaactggaggcggctctgggcgtgaagtgggcaagcaagccggttgttaaaccggtgaccgagaaacgcccggtcgcggcgaagaagccggcagttcgtaagccggcgactgcaaaagttggtgccggtaagccggtcaaagctccggaggattaa

SEQ ID NO: 43 - protein, 489 aa, Unknown
  Description of Unknown: Marine metagenome polypeptide
MARTPLNVQDATFLSVETADYPTHIAGLQIFEMPEADPDFVGRLVERLVQAPVAPFWRRVLAPGFLGSTLSADWIEAEEIDLDFHVRRMALPRPGSLEQLEHLVERLHARPLDRSRPLWECYFVEGLGPNRFAIYAKVHHALVDGMGGIWLALAALAQDPEAEPTAPWSVDLPSRPRAPAPSLLDRLTGGARLVNDLSMQNLRQSLDWAGRLAGAHARADLPFAAPHTPFNGRVDGYRRFVTKSLPLTRVKAVAKATGTTINDVVLALTGAALRTWLDGQGALPERSLVASVPVSVRAADGAGNNLSALLADLGTDVETPLERLQRVRESTARGKDMIARLSRGAAEAWALVMGLAGLAPALVNGGRTLPPLANLVISNVPGPRGKRYYAGAELIGYYPVSILTHGQGLNVTLVSRGESIDFGLTGAQSLIRDLDKLGDALEAALADYEAAVGDDLAQRNAAFTAAVPAPVVDVEAGDGAARPGVTRVA

SEQ ID NO: 44 - DNA, 1470 bp, Artificial Sequence
  Description of Artificial Sequence: Synthetic polynucleotide
atggcacgtacgccgctgaatgttcaggatgcaacctttctgtctgttgaaaccgcggattacccgacgcatattgcgggtttgcagatcttcgaaatgccggaggccgatccggattttgttggtcgcctggtcgaacgcctggtccaggctccggtcgcgcctttctggcgtcgtgtgctggcccctggcttcctgggtagcaccctgagcgcagactggattgaagcggaagagatcgacctggatttccacgtccgtcgtatggcgctgccgcgtccgggcagcctggagcaactggaacacctggttgagcgtctgcacgcacgtccgctggaccgtagccgcccactgtgggaatgctatttcgtcgaaggtctgggtccgaaccgctttgccatctacgccaaagtccaccacgcgctggtcgatggtatgggcggcatctggttggccctggccgcattggcacaagatccggaggcggagccgactgccccgtggtccgtggatctgccgagccgtccgcgtgctccggcaccatccctgctggaccgcctgaccggcggtgcgcgtctggtgaatgacctgagcatgcaaaacctgcgccagagcctggattgggcaggtcgtctggcaggcgcccatgcacgcgcggacctgccattcgctgcgccgcatacgccgttcaatggccgcgtcgacggctaccgtcgttttgttaccaagtcgttgcctctgacccgtgttaaggccgttgccaaggcgacgggtaccaccatcaacgacgttgttctggcgctgacgggtgcggcgttgcgcacctggctggatggccaaggcgcgctgccggagcgcagcttggtggcgagcgttccggtgtctgttcgtgccgcggatggcgctggcaacaacctgagcgcgctgctggccgacctgggcacggatgtcgagactccgttggagcgcctgcagcgtgttcgtgagagcaccgcacgtggtaaggacatgattgcacgtctgtcccgtggtgcggcggaggcttgggcgctggtcatgggtctggcgggtctggctccggcgctggtgaacggtggccgtaccctgccgccactggccaatctggtcattagcaacgtgccgggtccgcgtggtaaacgctattacgcaggtgcggaactgatcggttactacccggttagcattctgacgcacggccaaggcctgaatgtgaccttggttagccgcggtgagagcatcgactttggtttgaccggtgcgcagtcgttgattcgcgatctggacaaactgggcgacgcgctggaggctgcactggcagactatgaggcagctgtgggtgatgacttggcacagcgcaatgcggcttttaccgcagctgtgccagcaccggtggtcgacgtggaagcgggtgatggtgcggcacgccctggcgtgacgcgtgtggcctaa

SEQ ID NO: 45 - protein, 479 aa, Unknown
  Description of Unknown: Whalefall sample polypeptide
MRLLTAVDQLFLLLESRKQPMHVGGLFVFELPDNADSDFVYQLVKQMQESDVPPSFPFNQVLEHLAFWKKDKDFDVEHHLHHVALPSPGRVRELLMYVSREHGRLLDRAMPLWECHVVEGIEPETEGSPERFALYFKIHHSLVDGIAAMRLVQKSLSQSATEPVTLPVWSLMARHRNHVNAILPAERSVKRIIKEQISTIKPVFTELLDNLKNYSDEGYVGTFDAPMSILNKRISASRRIAAQSYDIKRFNDIAERLNISKNDVVLAVCSGALRRYLISMDALPSKPLIAFVPMSLRTDKSVSGNQLSFVLANLGTHLDNPLRRIELIHRSMNNGKRRFRRMNQAQVINYSVIAYAWEGINLATGLFPKKQAFNLIISNVPGSEKPLYWNGARLQSLYPASIVFNGQAMNITLASYLDKIEFGITACSKALPRVQDMLMLIEEELQLLETTSKELAFKGITVEDKAGNKGDDKTKKLTP

SEQ ID NO: 46 - DNA, 1440 bp, Artificial Sequence
  Description of Artificial Sequence: Synthetic polynucleotide
atgagactgttgacggctgttgaccaactgtttctgttgctggagagccgtaagcaaccgatgcatgtcggcggtctgtttgttttcgagctgccggacaacgcggacagcgattttgtgtaccaactggttaagcaaatgcaagaaagcgacgtgccgccttcgtttccgttcaatcaggtcctggagcatctggctttttggaagaaagataaagattttgatgttgaacaccacttgcaccacgtggccctgccgtccccgggtcgtgtccgtgagctgctgatgtacgttagccgtgagcacggtcgtctgctggaccgcgcaatgccattgtgggaatgccatgttgttgagggtatcgaaccggaaaccgaaggtagcccggagcgttttgcactgtatttcaaaatccatcacagcctggttgatggtattgcagctatgcgtttggtgcagaaaagcctgagccaaagcgcgaccgaaccggtcacgctgccggtgtggagcctgatggcacgtcatcgtaaccacgtcaacgcgattctgccggctgaacgcagcgtgaagcgtatcatcaaagagcagatcagcaccatcaaaccggtgttcacggaactgctggataatctgaaaaactactccgacgagggctatgtcggtaccttcgatgcacctatgagcatcctgaacaagcgcatttctgcctcccgccgtattgcggcacagagctacgacatcaagcgtttcaacgacattgcggagcgtctgaacattagcaagaacgatgtggtcctggcggtttgcagcggtgccctgcgccgttatctgattagcatggacgcgctgccgagcaaaccgttgatcgcgtttgtccctatgagcttgcgcacggacaaatccgttagcggcaatcagctgagcttcgtcctggcgaatctgggcactcacctggataacccgctgcgtcgtattgagttgattcatcgttctatgaacaatggtaagcgtcgcttccgccgtatgaaccaagcacaggtgatcaattacagcgtcatcgcgtatgcatgggagggtatcaatctggccaccggcctgtttccaaagaagcaagccttcaatctgatcatctctaacgtgccgggttcggagaaaccgctgtactggaatggtgcccgcttgcagtccctgtatccggcgagcattgtgtttaacggtcaggcgatgaatatcacgctggcgtcttatctggacaagattgagttcggcatcaccgcctgttctaaggcgctgccgcgtgttcaagatatgctgatgctgattgaagaagagctgcagttgctggaaacgactagcaaagaactggcattcaaaggcattaccgttgaggacaaggcgggtaacaagggcgacgacaaaaccaagaaactgaccccataa

SEQ ID NO: 47 - DNA, 46 bp, Artificial Sequence
  Description of Artificial Sequence: Synthetic primer
  modified_base (27)..(28): a, c, t, g, unknown or other
ccatttccaacgtgcccggcccggaannkacgctgtattatgaagg

SEQ ID NO: 48 - DNA, 7518 bp, Artificial Sequence
  Description of Artificial Sequence: Synthetic polynucleotide
ggccgcagggcggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatatcgacggtcgaggagaacttctagtatatccacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagaggccggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatttcaaggatataccattctaatgtctgcccctatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtggctggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatcttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggttgaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccaccgaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatagtaaaggaatacaggtaagcaaattgatactaatggctcaacgtgataaggaaaaagaattgcactttaacattaatattgacaaggaggagggcaccacacaaaaagttaggtgtaacagaaaatcatgaaactacgattcctaatttgatattggaggattttctctaaaaaaaaaaaaatacaacaaataaaaaacactcaatgacctgaccatttgatggagtttaagtcaataccttcttgaagcatttcccataatggtgaaagttccctcaagaattttactctgtcagaaacggccttacgacgtagtcgatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctccaccgcgggatttcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaaatcactagtggatccgcccagc

SEQ ID NO: 49 - DNA, 7899 bp, Artificial Sequence
  Description of Artificial Sequence: Synthetic polynucleotide
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgggcgtcgttgcttgtgtgatttttgaggacccatccctttggtatataagtatactctggggttaaggttgcccgtgtagtctaggttatagttttcatgtgaaataccgagagccgagggagaataaacgggggtatttggacttgtttttttcgcggaaaagcgtcgaatcaaccctgcgggccttgcaccatgtccacgacgtgtttctcgccccaattcgccccttgcacgtcaaaattaggcctccatctagacccctccataacatgtgactgtggggaaaagtataagggaaaccatgcaaccatagacgacgtgaaagacggggaggaaccaatggaggccaaagaaatggggtagcaacagtccaggagacagacaaggagacaaggagagggcgcccgaaagatcggaaaaacaaacatgtccaattggggcagtgacggaaacgacacggacacttcagtacaatggaccgaccatctccaagccagggttattccggtatcaccttggccgtaacctcccgctggtacctgatattgtacacgttcacattcaatatactttcagctacaataagagaggctgtttgtcgggcatgtgtgtccgtcgtatggggtgatgtccgagggcgaaattcgctacaagcttaactctggcgcttgtccagtatgaatagacaagtcaagaccagtggtgccatgattgacagggaggtacaagacttcgatactcgagcattactcggacttgtggcgattgaacagacgggcgatcgcttctcccccgtattgccggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcgctgatgacactttggtctgaaagagatgcattttgaatcccaaacttgcagtgcccaagtgacatacatctccgcgttttggaaaatgttcagaaacagttgattgtgttggaatggggaatggggaatggaaaaatgactcaagtatcaattccaaaaacttctctggctggcagtacctactgtccatactactgcattttctccagtcaggccactctatactcgacgacacagtagtaaaacccagataatttcgacataaacaagaaaacagacccaataatatttatatatagtcagccgtttgtccagttcagactgtaatagccgaaaaaaaatccaaagtttctattctaggaaaatatattccaatatttttaattcttaatctcatttattttattctagcgaaatacatttcagctacttgagacatgtgatacccacaaatcggattcggactcggttgttcagaagagcatatggcattcgtgctcgcttgttcacgtattcttcctgttccatctcttggccgacaatcacacaaaaatggggttttttttttaattctaatgattcattacagcaaaattgagatatagcagaccacgtattccataatcaccaaggaagttcttgggcgtcttaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcaaacggtaggttagtgcttggtatatgagttgtaggcatgacaatttggaaaggggtggactttgggaatattgtgggatttcaataccttagtttgtacagggtaattgttacaaatgatacaaagaactgtatttcttttcatttgttttaattggttgtatatcaagtccgttagacgagctcagtgccttggcttttggcactgtatttcatttttagaggtacactacattcagtgaggtatggtaaggttgagggcataatgaaggcaccttgtactgacagtcacagacctctcaccgagaattttatgagatatactcgggttcattttaggctcatcgatgagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccaaggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggcttccgccgaattcaccgccgctgccgactctgtgcagaagcttcccaagactccttccgacgacgagcttcttgagctctacggactgtacaagcaggccaccgtcggcgacaacaacaccgaccgacccggcgccttcaacttcaaggccaagtacaagtgggacgcctgggacaagctcaagggcaagtctcaggaggaggctgagcaggagtacattgctcttgtccagaccctttccgacaagtacaactaagc

SEQ ID NO: 50 - DNA, 7494 bp, Artificial Sequence
  Description of Artificial Sequence: Synthetic polynucleotide
ggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatcgactacgtcgtaaggccgtttctgacagagtaaaattcttgagggaactttcaccattatgggaaatgcttcaagaaggtattgacttaaactccatcaaatggtcaggtcattgagtgttttttatttgttgtatttttttttttttagagaaaatcctccaatatcaaattaggaatcgtagtttcatgattttctgttacacctaactttttgtgtggtgccctcctccttgtcaatattaatgttaaagtgcaattctttttccttatcacgttgagccattagtatcaatttgcttacctgtattcctttactatcctcctttttctccttcttgataaatgtatgtagattgcgtatatagtttcgtctaccctatgaacatattccattttgtaatttcgtgtcgtttctattatgaatttcatttataaagtttatgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggccttaccttcttcaggcaagttcaatgacaatttcaacatcattgcagcagacaagatagtggcgatagggtcaaccttattctttggcaaatctggagcagaaccgtggcatggttcgtacaaaccaaatgcggtgttcttgtctggcaaagaggccaaggacgcagatggcaacaaacccaaggaacctgggataacggaggcttcatcggagatgatatcaccaaacatgttgctggtgattataataccatttaggtgggttgggttcttaactaggatcatggcggcagaatcaatcaattgatgttgaaccttcaatgtagggaattcgttcttgatggtttcctccacagtttttctccataatcttgaagaggccaaaagattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctgacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccagccacagcacctaacaaaacggcatcaaccttcttggaggcttccagcgcctcatctggaagtgggacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacataggggcagacattagaatggtatatccttgaaatatatatatatattgctgaaatgtaaaaggtaagaaaagttagaaagtaagacgattgctaaccacctattggaaaaaacaataggtccttaaataatattgtcaacttcaagtattgtgatgcaagcatttagtcatgaacgcttctctattctatatgaaaagccggttccggcctctcacctttcctttttctcccaatttttcagttgaaaaaggtatatgcgtcaggcgacctctgaaattaacaaaaaatttccagtcatcgaatttgattctgtgcgatagcgcccctgtgtgttctcgttatgttgaggaaaaaaataatggttgctaagagattcgaactcttgcatcttacgatacctgagtattcccacagttaactgcggtcaagatatttcttgaatcaggcgccttagaccgctcggccaaacaaccaattacttgttgagaaatagagtataattatcctataaatataacgtttttgaacacacatgaacaaggaagtacaggacaattgattttgaagagaatgtggattttgatgtaattgttgggattccatttttaataaggcaataatattaggtatgtggatatactagaagttctcctcgaccgtcgatatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccactagtgatttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaaatcccgc

SEQ ID NO: 51 - DNA, 6991 bp, Artificial Sequence
  Description of Artificial Sequence: Synthetic polynucleotide
gcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatgg

SEQ ID NO: 52 - DNA, 26 bp, Artificial Sequence
  Description of Artificial Sequence: Synthetic primer
ttccgggccgggcacgttggaaatgg

SEQ ID NO: 53 - skipped

SEQ ID NO: 54 - protein, 1174 aa, Nocardia sp.
MAVDSPDERLQRRIAQLFAEDEQVKAARPLEAVSAAVSAPGMRLAQIAATVMAGYADRPAAGQRAFELNTDDATGRTSLRLLPRFETITYRELWQRVGEVAAAWHHDPENPLRAGDFVALLGFTSIDYATLDLADIHLGAVTVPLQASAAVSQLIAILTETSPRLLASTPEHLDAAVECLLAGTTPERLVVFDYHPEDDDQRAAFESARRRLADAGSLVIVETLDAVRARGRDLPAAPLFVPDTDDDPLALLIYTSGSTGTPKGAMYTNRLAATMWQGNSMLQGNSQRVGINLNYMPMSHIAGRISLFGVLARGGTAYFAAKSDMSTLFEDIGLVRPTEIFFVPRVCDMVFQRYQSELDRRSVAGADLDTLDREVKADLRQNYLGGRFLVAVVGSAPLAAEMKTFMESVLDLPLHDGYGSTEAGASVLLDNQIQRPPVLDYKLVDVPELGYFRTDRPHPRGELLLKAETTIPGYYKRPEVTAEIFDEDGFYKTGDIVAELEHDRLVYVDRRNNVLKLSQGEFVTVAHLEAVFASSPLIRQIFIYGSSERSYLLAVIVPTDDALRGRDTATLKSALAESIQRIAKDANLQPYEIPRDFLIETEPFTIANGLLSGIAKLLRPNLKERYGAQLEQMYTDLATGQADELLALRREAADLPVLETVSRAAKAMLGVASADMRPDAHFTDLGGDSLSALSFSNLLHEIFGVEVPVGVVVSPANELRDLANYIEAERNSGAKRPTFTSVHGGGSEIRAADLTLDKFIDARTLAAADSIPHAPVPAQTVLLTGANGYLGRFLCLEWLERLDKTGGTLICVVRGSDAAAARKRLDSAFDSGDPGLLEHYQQLAARTLEVLAGDIGDPNLGLDDATWQRLAETVDLIVHPAALVNHVLPYTQLFGPNVVGTAEIVRLAITARRKPVTYLSTVGVADQVDPAEYQEDSDVREMSAVRVVRESYANGYGNSKWAGEVLLREAHDLCGLPVAVFRSDMILAHSRYAGQLNVQDVFTRLILSLVATGIAPYSFYRTDADGNRQRAHYDGLPADFTAAAITALGIQATEGFRTYDVLNPYDDGISLDEFVDWLVESGHPIQRITDYSDWFHRFETAIRALPEKQRQASVLPLLDAYRNPCPAVRGAILPAKEFQAAVQTAKIGPEQDIPHLSAPLIDKYVSDLELLQLL

SEQ ID NO: 55 - protein, 1168 aa, Mycobacterium tuberculosis
MSINDQRLTRRVEDLYASDAQFAAASPNEAITQAIDQPGVALPQLIRMVMEGYADRPALGQRALRFVTDPDSGRTMVELLPRFETITYRELWARAGTLATALSAEPAIRPGDRVCVLGFNSVDYTTIDIALIRLGAVSVPLQTSAPVTGLRPIVTETEPTMIATSIDNLGDAVEVLAGHAPARLVVFDYHGKVDTHREAVEAARARLAGSVTIDTLAELIERGRALPATPIADSADDALALLIYTSGSTGAPKGAMYRESQVMSFWRKSSGWFEPSGYPSITLNFMPMSHVGGRQVLYGTLSNGGTAYFVAKSDLSTLFEDLALVRPTELCFVPRIWDMVFAEFHSEVDRRLVDGADRAALEAQVKAELRENVLGGRFVMALTGSAPISAEMTAWVESLLADVHLVEGYGSTEAGMVLNDGMVRRPAVIDYKLVDVPELGYFGTDQPYPRGELLVKTQTMFPGYYQRPDVTAEVFDPDGFYRTGDIMAKVGPDQFVYLDRRNNVLKLSQGEFIAVSKLEAVFGDSPLVRQIFIYGNSARAYPLAVVVPSGDALSRHGIENLKPVISESLQEVARAAGLQSYEIPRDFIIETTPFTLENGLLTGIRKLARPQLKKFYGERLERLYTELADSQSNELRELRQSGPDAPVLPTLCRAAAALLGSTAADVRPDAHFADLGGDSLSALSLANLLHEIFGVDVPVGVIVSPASDLRALADHIEAARTGVRRPSFASIHGRSATEVHASDLTLDKFIDAATLAAAPNLPAPSAQVRTVLLTGATGFLGRYLALEWLDRMDLVNGKLICLVRARSDEEAQARLDATFDSGDPYLVRHYRELGAGRLEVLAGDKGEADLGLDRVTWQRLADTVDLIVDPAALVNHVLPYSQLFGPNAAGTAELLRLALTGKRKPYIYTSTIAVGEQIPPEAFTEDADIRAISPTRRIDDSYANGYANSKWAGEVLLREAHEQCGLPVTVFRCDMILADTSYTGQLNLPDMFTRLMLSLAATGIAPGSFYELDAHGNRQRAHYDGLPVEFVAEAICTLGTHSPDRFVTYHVMNPYDDGIGLDEFVDWLNSPTSGSGCTIQRIADYGEWLQRFETSLRALPDRQRHASLLPLLHNYREPAKPICGSIAPTDQFRAAVQEAKIGPDKDIPHLTAAIIAKYISNLRLLGLL

SEQ ID NO: 56 - protein, 1168 aa, Mycobacterium smegmatis
MTIETREDRFNRRIDHLFETDPQFAAARPDEAISAAAADPELRLPAAVKQILAGYADRPALGKRAVEFVTDEEGRTTAKLLPRFDTITYRQLAGRIQAVTNAWHNHPVNAGDRVAILGFTSVDYTTIDIALLELGAVSVPLQTSAPVAQLQPIVAETEPKVIASSVDFLADAVALVESGPAPSRLVVFDYSHEVDDQREAFEAAKGKLAGTGVVVETITDALDRGRSLADAPLYVPDEADPLTLLIYTSGSTGTPKGAMYPESKTATMWQAGSKARWDETLGVMPSITLNFMPMSHVMGRGILCSTLASGGTAYFAARSDLSTFLEDLALVRPTQLNFVPRIWDMLFQEYQSRLDNRRAEGSEDRAEAAVLEEVRTQLLGGRFVSALTGSAPISAEMKSWVEDLLDMHLLEGYGSTEAGAVFIDGQIQRPPVIDYKLVDVPDLGYFATDRPYPRGELLVKSEQMFPGYYKRPEITAEMFDEDGYYRTGDIVAELGPDHLEYLDRRNNVLKLSQGEFVTVSKLEAVFGDSPLVRQIYVYGNSARSYLLAVVVPTEEALSRWDGDELKSRISDSLQDAARAAGLQSYEIPRDFLVETTPFTLENGLLTGIRKLARPKLKAHYGERLEQLYTDLAEGQANELRELRRNGADRPVVETVSRAAVALLGASVTDLRSDAHFTDLGGDSLSALSFSNLLHEIFDVDVPVGVIVSPATDLAGVAAYIEGELRGSKRPTYASVHGRDATEVRARDLALGKFIDAKTLSAAPGLPRSGTEIRTVLLTGATGFLGRYLALEWLERMDLVDGKVICLVRARSDDEARARLDATFDTGDATLLEHYRALAADHLEVIAGDKGEADLGLDHDTWQRLADTVDLIVDPAALVNHVLPYSQMFGPNALGTAELIRIALTTTIKPYVYVSTIGVGQGISPEAFVEDADIREISATRRVDDSYANGYGNSKWAGEVLLREAHDWCGLPVSVFRCDMILADTTYSGQLNLPDMFTRLMLSLVATGIAPGSFYELDADGNRQRAHYDGLPVEFIAEAISTIGSQVTDGFETFHVMNPYDDGIGLDEYVDWLIEAGYPVHRVDDYATWLSRFETALRALPERQRQASLLPLLHNYQQPSPPVCGAMAPTDRFRAAVQDAKIGPDKDIPHVTADVIVKYISNLQMLGLL

SEQ ID NO: 57 - protein, 1173 aa, Mycobacterium smegmatis
MTSDVHDATDGVTETALDDEQSTRRIAELYATDPEFAAAAPLPAVVDAAHKPGLRLAEILQTLFTGYGDRPALGYRARELATDEGGRTVTRLLPRFDTLTYAQVWSRVQAVAAALRHNFAQPIYPGDAVATIGFASPDYLTLDLVCAYLGLVSVPLQHNAPVSRLAPILAEVEPRILTVSAEYLDLAVESVRDVNSVSQLVVFDHHPEVDDHRDALARAREQLAGKGIAVTTLDAIADEGAGLPAEPIYTADHDQRLAMILYTSGSTGAPKGAMYTEAMVARLWTMSFITGDPTPVINVNFMPLNHLGGRIPISTAVQNGGTSYFVPESDMSTLFEDLALVRPTELGLVPRVADMLYQHHLATVDRLVTQGADELTAEKQAGAELREQVLGGRVITGFVSTAPLAAEMRAFLDITLGAHIVDGYGLTETGAVTRDGVIVRPPVIDYKLIDVPELGYFSTDKPYPRGELLVRSQTLTPGYYKRPEVTASVFDRDGYYHTGDVMAETAPDHLVYVDRRNNVLKLAQGEFVAVANLEAVFSGAALVRQIFVYGNSERSFLLAVVVPTPEALEQYDPAALKAALADSLQRTARDAELQSYEVPADFIVETEPFSAANGLLSGVGKLLRPNLKDRYGQRLEQMYADIAATQANQLRELRRAAATQPVIDTLTQAAATILGTGSEVASDAHFTDLGGDSLSALTLSNLLSDFFGFEVPVGTIVNPATNLAQLAQHIEAQRTAGDRRPSFTTVHGADATEIRASELTLDKFIDAETLRAAPGLPKVTTEPRTVLLSGANGWLGRFLTLQWLERLAPVGGTLITIVRGRDDAAARARLTQAYDTDPELSRRFAELADRHLRVVAGDIGDPNLGLTPEIWHRLAAEVDLVVHPAALVNHVLPYRQLFGPNVVGTAEVIKLALTERIKPVTYLSTVSVAMGIPDFEEDGDIRTVSPVRPLDGGYANGYGNSKWAGEVLLREAHDLCGLPVATFRSDMILAHPRYRGQVNVPDMFTRLLLSLLITGVAPRSFYIGDGERPRAHYPGLTVDFVAEAVTTLGAQQREGYVSYDVMNPHDDGISLDVFVDWLIRAGHPIDRVDDYDDWVRRFETALTALPEKRRAQTVLPLLHAFRAPQAPLRGAPEPTEVFHAAVRTAKVGPGDIPHLDEALIDKYIRDLREFGLI

SEQ ID NO: 58 - protein, 1174 aa, Mycobacterium ulcerans
MSPITREERLERRIQDLYANDPQFAAAKPVTAITAAIERPGLPLPQIIETVMTGYADRPALAQRSVEFVTDAGTGHTTLRLLPHFETISYGELWDRISALADVLSTEQTVKPSDRVCLLGFNSVDYATIDMTLARLGAVAVPLQTSAAITQLQPIVAETQPTMIAASVDALADATELALSGQTATRVLVFDHHRQVDAHRAAVESARERLAGSAVVETLAEAIARGDVPRGASAGSAPGTDVSDDSLALLIYTSGSTGAPKGAMYPRRNVATFWRKRTWFEGGYEPSITLNFMPMSHVMGRQILYGTLCNGGTAYFVVKSDLSTLFEDLALVRPTELTFVPRVWDMVFDEFQSEVDRRLVDGADRVALEAQVKAEIRNDVLGGRYTSALTGSAPISDEMKAWVEELLDMHLVEGYGSTEAGMILIDGAIRRPAVLDYKLVDVPDLGYFLTDRPHPRGELLVKTDSLFPGYYQRAEVTADVFDADGFYRTGDIMAEVGPEQFVYLDRRNNVLKLSQGEFVTVSKLEAVFGDSPLVRQIYIYGNSARAYLLAVIVPTQEALDAVPVEELKARLGDSLQEVAKAAGLQSYEIPRDFIIETTPWTLQNGLLTGIRKLARPQLKKHYGELLEQIYTDLAHGQADELRSLRQSGADAPVLVTVCRAAAALLGGSASDVQPDAHFTDLGGDSLSALSFTNLLHEIFDIDVPVGVIVSPANDLQALADYVEAARKPGSSRPTFASVHGASNEQVTEVHAGDLSLDKFIDAATLAEAPRLPAANTQVRTVLLTGATGFLGRYLALEWLERMDLVDGKLICLVRAKSDTEARARLEKTFDSGAPELLAHYRALAGDHLEVLAGDKGEADLGLDRQTWQRLADTVDLIVDPAALVNHVLPYSQLFGPNALGTAELLRLALTSKIKPYSYTSTIGVADQIPPSAFTEDADIRVISATRAVDDSYANGYSNSKWAGEVLLREAHVLCGLPVAVFRCDMILADTTWAGQLNVPDMFTRMILSLAATGIAPGSFYELAADGARQRAHYDGLPVEFIAEAISTLGAQSQDGFHTYHVMNPYDDGIGLDEFVDWLNESGCPIQRIADYGDWLQRFETALRALPDRQRHSSLLPLLHNYRQPERPVRGSIAPTDRFRAAVQEAKIGPDKDIPHVGAPIIVKYVSDLRLLGLL

SEQ ID NO: 59 - protein, 1105 aa, Tsukamurella paurometabola
MSIETVQNGVPAEGSVPPADQQTERLPQVIARIFAQFADRPAFATREAGPGTPYATVSYREIWRRVTALVASWQSEVAPGDFVAILGFTSSDFVTVDLATTLLGAPNVPLQAGAPAARIATILDETRPKILAVSADQVDLAQEALAESAATPRVVVFDGERDGYEGIEADILSGSALPAPEFFAPEPGTDPLVTLIYTSGSTGTPKGAMYTEQLVRDAWLKVDSIVDIDMPAESLLHFLPMSHMYGRNWLIAGLASGGTGYFAGASDMSTLFDDLAAARPTAIGLVPRVCELIHQRYLAVEADTDAETARVELRDRVLGGRLQAAMCGSAALSSELQTFMEWLLGIDIQIGYGSTEAGGVIRDGVVVRPPVTEYKLIDVPELGYFVTDSPHPRGELLVKSTQLIPGYYNSDKRIRDDEGFYRTGDVMAELGPDRLEYVDRRSNVIKLAQGEFVPIAQLEAIYAAGPDVHQIFLYGTSERSYLIGVVVPAPGPDGETDAQTRTRVLDGLAAIARENDLAAYEVPRDVLIERDPFSQENGLRSGIGKLVRPALIARYGDRLHDLYAQADTRQREGLRALDASGPIIDTVLGAAALTLGADIADFDADTRFGDLGGDSLSALSLATTLEGLYDVPVPVQTIVGPTATLGGVARHIEKARSGGVAAPTADSVHGVGASVARATDLTLEKFIDPELLALAPTLPAATGEPNTVLLTGSTGYLGRFLLLDWLRRVAPHGGTVIALVRGADADDARRRVTAAIGDSDPDLTQEFTSLAEHHLHVIAGDFGSPALGLDDATWSDLAGRVDHVVHCGALVNHVLPYDQLFGPNVVATGEVVRLALTTRRKSVDYVSTVAVVPQDDGRVLVEDDDVRELGAERRIGADAYANGYAVSKWAGEVLLHEAADLADLPVRVFRSDMILAHSRFHGQFNEVDQFTRLLLSIAETGLAPASFYTPDPSGHRPHYDGLPVDFTAEAITTLSAAGRSGYRTFHVLNANDDGVSLDSFVDWIAASGRSIERIDDYDTWFARFEQALQQLPDEARQRSVLPLLHAVREPAPAAGTSALSVDRFRGAVRETGVGPGDIPVLDRALIEKYLRDFETAGWLAPGARD

SEQ ID NO: 60 - protein, 1144 aa, Cyanobium sp.
MNESSADQSSGNVSEGWPDASVTARALQAHLRYEQIIDAILSGYAERPALAERSYLVRPDPSTGQTVRVHEQAFRSISYRTLQERVHALTMAWRLHPDSPVQAGAFVVLVGFASIDYAVLDLALAYTKGVPVPLSPNHSSEDDDAILGTVQPVTLAVSISEFSGCVDLIARSTSIRTVIVFDLDPAVDCERAALESGIRALNEKGSDVVVQTLQDLIDVGRDAEFSFLPIQAQDQDDLALLIHTSGSTGTPKGACISSRALINTWRHVSGPYPKVTVVLAPFHHMMGRDSMITALGAGGTAYFTLRPDLSTVIEDIRLARPTGLVLFPRLCEVIEHHLTTAPEYSGNEILGGRLQSIVVASAPITPRLKASLECLLGVPVSEGYSSTETASGGLAMNGLLNRNNILAYRLRDVPEAGYSVNDRPFPRGELCVKTRFGISGYFRNPEATAELFDDDGFYCTGDIVEERAPDQIAIIDRRKNVIKLAQGEYVAVGRLEQLFQEGCGCVQQIHLHGDSTRAYLLAVVVPDRNTLAPPGSRQASEAELKARVREEILTLANQRELRGFEIPRDLILAEEPFSQQNGLLSSLGKPIRPAIRARYRSRLESLYASHEATRGTELEAIRASAGAVDVETTLLALLSSTLGVVCGAADRQTSFRELGGDSLAAVQLAMEIKKQFGVGLEGSQILGPGGTVEAWARRIHTASIQQAPHQRVGSPLAAIPAEGWLKPDHYRLENLIGIPIGTPSAEVARPTGGPPTVLLTGATGFLGGRLCLEWLQRLAGQGGRLICLVRPSNSHSAWERLRNRFSHLEPEQVARFRELAGRHLEVIPADIGEPGLGLEPGCQERLATEVDAICHCAAEVNHRLPYRHLYRPNVIGTAEIIHLAITTRLKSVDFISSIGVASLPRRPGGSIPVEGGYARGYFASKWACEQLLRSTHDCTGVPVRVIRPSLILPDRVLAGEMNPDDLLSRLLYSILVTGIAPGCFGEESQNSGRSGFSVQGLPVDQLAQTILALGEARTEGFHVLNLNADSGSGVPLDAILQDIAAKGIRLRRVEGYDLWLDAITTRLRRLPAEQRARSLLDVAEAYAGSAGQTTQSSGEMQAGSSSCPEEITSLQPDFSRAYRRKIVDDLARWGLIEPPGPVDQ

SEQ ID NO: 61 - protein, 1173 aa, Mycobacterium avium
MSTATHDERLDRRVHELIATDPQFAAAQPDPAITAALEQPGLRLPQIIRTVLDGYADRPALGQRVVEFVTDAKTGRTSAQLLPRFETITYGEVAQRVSALGRALSDDAVHPGDRVCVLGFNSVDYATIDMALGAIGAVSVPLQTSAAISSLQPIVAETEPTLIASSVNQLSDAVQLITGAEQAPTRLVVFDYHPQVDDQREAVQDAAARLSGTGVAVQTLAELLERGKDLPAVAEPPADEDSLALLIYTSGSTGAPKGAMYPQSNVGKMWRRGSKNWFGESAASITLNFMPMSHVMGRSILYGTLGNGGTAYFAARSDLSTLLEDLELVRPTELNFVPRIWETLYGEFQRQVERRLSEAGDAGERRAVEAEVLAEQRQYLLGGRFTFAMTGSAPISPELRNWVESLLEMHLMDGYGSTEAGMVLFDGEIQRPPVVDYKLVDVPDLGYFSTDRPHPRGELLLRTENMFPGYYKRAETTAGVFDEDGYYRTGDVFAEIAPDRLVYVDRRNNVLKLAQGEFVTLAKLEAVFGNSPLIRQIYVYGNSAQPYLLAVVVPTEEALASGDPETLKPKIADSLQQVAKEAGLQSYEVPRDFIIETTPFSLENGLLTGIRKLAWPKLKQHYGERLEQMYADLAAGQADELAELRRNGAQAPVLQTVSRAAGAMLGSAASDLSPDAHFTDLGGDSLSALTFGNLLREIFDVDVPVGVIVSPANDLAAIASYIEAERQGSKRPTFASVHGRDATVVRAADLTLDKFLDADTLASAPNLPKPATEVRTVLLTGATGFLGRYLALEWLERMDMVDGKVIALVRARSDEEARARLDKTFDSGDPKLLAHYQQLAADHLEVIAGDKGEANLGLRQDVWQRLADTVDVIVDPAALVNHVLPYSELFGPNALGTAELIRLALTSKQKPYTYVSTIGVGDQIEPGKFVENADIRQMSATRAINDSYANGYGNSKWAGEVLLREAHDLCGLPVAVFRCDMILADTTYAGQLNLPDMFTRLMLSLVATGIAPGSFYELDADGNRQRAHYDGLPVEFIAAAISTLGSQITDSDTGFQTYHVMNPYDDGIGLDEYVDWLVDAGYSIERIADYSEWLRRFETSLRALPDRQRQYSLLPLLHNYRTPEKPINGSIAPTDVFRAAVQEAKIGPDKDIPHVSPPVIVKYITDLQLLGLL

SEQ ID NO: 62 - protein, 1168 aa, Mycobacterium smegmatis; identical to SEQ ID NO: 56

SEQ ID NO: 63 - protein, 1174 aa, Mycobacterium intracellulare
MSTAIHDEHLDRRIEELIANDPQFAAARPDPAITAATEAPGLRLPQIIRTVLDGYADRPALAQRVVEFVTDAKTGRTTAELLPRFETITYGELGERVSALGRAWAGDAVRPGDRVCVLGFNSVDYATIDIALGTIGAVSVPLQTSAAISSLQPIVAETEPSLIASSVNQLPDAVELILAGDHVPGKLVVFDYQPQVDDQREAVEAAAARLADSGVAVEALADVLRRGKDLPAVEPPASDEDSLALLIYTSGSTGAPKGAMYPQSNVGKMWRRGSKNWFGESAASITLNFMPMSHVMGRGILYGTLGNGGTAYFAARSDLSTLLEDLELVRPTEMNFVPRIWETLYGEFQRQVERRLADGDAGPEARETVAAAVLEEQRQYLLGGRFIFAMTGSAPTSPELKAWAESLLQMHLMDGYGSTEAGMVLFDGEIQRPPVIDYKLVDVPDLGYFSTDRPHPRGELLLRTENMFPGYYKRAETTANVFDEDGYYRTGDVFAEIAPDRLVYVDRRNNVLKLAQGEFVTLAKLEAVFGNSPLIRQIYVYGNSSQPYLLAVVVPTEEALADNDLESLKPKIADSLQKVAKETGLQSYEVPRDFIIETTPFTLENGLLTGIRKLAWPKLKAHYGDRLEQMYAELAAGQANELAELRRSGAAAPVAQTVSRAAAALLGATAGDLSADAHFTDLGGDSLSALTFGNLLREIFDVDVPVGVIVSPANDLAGIAAYIEAERQGSKRPTFAAVHGRGATMVHASDLTLDKFLDEATLAAAPSLPKPATEVRTVLLTGATGFLGRYLALDWLERMDMVDGKVIALVRARTDEEARARLDKTFDSGDPKLLAHYQRLAADHLEVIAGDKGEANLGLDPQTWQRLAEEVDVIVDPAALVNHVLPYSELFGPNALGTAELIRIALTSRQKPYTYVSTIGVGDQIQPGEFVENADIRQISATREINDGYANGYGNSKWAGEVLLREAHDLCGLPVTVFRCDMILADTTYAGQLNLPDMFTRLMLSLVATGIAPGSFYELDADGNRQRAHYDGLPVEFIAAAISTLGTQITDSDTGFQTYHVMNPYDDGIGLDEYIDWLIEAGYSIERIADYSEWLRRFETSLRALPDRQRQYSLLPLLHNYQKPEKPINGSMAPTDVFRAAVQEAKIGPDKDIPHVSAPVIVKYITDLELLGLL

SEQ ID NO: 64 - protein, 1173 aa, Mycobacterium smegmatis; identical to SEQ ID NO: 57

SEQ ID NO: 65 - protein, 1174 aa, Mycobacterium kansasii
MSTTTRDERLERRIDTLIHDDAQFAAAKPDPAIAAALEKPGLSLPEIIQTALQGYADRPALGQRAVEFVTDTQTGRTSVRLLTRFETITYRQLGDRVGALARALTHDSVHAGDRVCVLGFNSLDYTTIDMALAKVGAVSVPLQTSAAVTQLQPIVAETEPTMMAASVNQLSDAVDVLLSGHLPAKLVVFDYHPEVDDQREALDTARERLADTAVVVQTLKDVLDHGATLAAGSVAEPLAASGDNDSLALLIYTSGSTGAPKGAMYRQSNVGKMWRRSSKNWFGPTAASITLNFMPMSHIMGRGVLYGTLGNGGTAYFAARSDLSTLLEDLRLVRPTELNFVPRIWETLYGEYQRAVDQRSVDPGEPAAREAVEAQVMAEQRQDLLGGRYIFAMTGSAPMSPELRNWVEALLEIPLLDGYGSTEAGMVMFDGEIQRPPVIDYKLVDVPDLGYFSTDQPYPRGELLLKTENMFPGYYKRPEVTASVFDADGYYRTGDVVAEVAPDRLVYVDRRNNVLKLAQGEFVTVAKLEAVFGNSPLVRQIYVYGNSAHPYLLAVVVPTEEASAGTDIAALKPLIADSLQTVAKEAGLQSYEVPRDFLIETTPFTLENGLLTGIRKLAWPKLRQHYGERLEQLYTELAASQANELSELRRSGAHAPVLETVSRAAGALLGAASTALSPDAHFTDLGGDSLSALTFGNLLREIFDVDVPVGVIVSPASDLAAIAAYIEGERQGSKRPTFAVIHGRDALEVHASDLTLDKFIDASTLAAAPVLPPPSAAVRTVLLTGATGFLGRYLALDWLERMDLVDGKVIALVRAKSDDDARARLDKTFDSGDPELLTHYRRLATDHLEVIAGDKGEANLGLDQLTWQRLADTVDLIVDPAALVNHVLPYSELFGPNALGTAELIRIALTGKLKPYTYVSTIGVGDQIEPGKFTEDADIRHISATRKINDSYANGYGNSKWAGEVLLREAHDLCGLPVAVFRCDMILADTTWAGQLNVPDMFTRMMLSLVATGIAPGSFYELDADGNRQRAHYDGLPVEFIAEAIATLGARDGKGFQTYHVMNPYDDGIGMDRFVDWLVDAGCAIHRIDDYGDWLRRFETALRGLPEKQRHASLLPLLHNYQKPAPPLRGSMAPTDRFRAAVQDAKVGPDKDIPHISPQIIAKYLSDLRLLGLL

SEQ ID NO: 66 - protein, 1168 aa, Mycobacterium bovis
MSINDQRLTRRVEDLYASDAQFAAASPNEAITQAIDQPGVALPQLIRMVMEGYADRPALGQRALRFVTDPDSGRTMVELLPRFETITYRELWARAGTLATALSAEPAIRPGDRVCVLGFNSVDYTTIDIALIRLGAVSVPLQTSAPVTGLRPIVTETEPTMIATSIDNLGDAVEVLAGHAPARLVVFDYHGKVDTHREAVEAARARLAGSVTIDTLAELIERGRALPATPIADSADDALALLIYTSGSTGAPKGAMYRESQVMSFWRKSSGWFEPSGYPSITLNFMPMSHVGGRQVLYGTLSNGGTAYYVAKSDLSTLFEDLALVRPTELCFVPRIWDMVFAEFHSEVDRRLVDGADRAALEAQVKAELRENVLGGRFVMALTGSAPISAEMTAWVESLLADVHLVEGYGSTEAGMVLNDGMVRRPAVIDYKLVDVPELGYFGTDQPYPRGELLVKTQTMFPGYYQRPDVTAEVFDPDGFYRTGDIMAKVGPDQFVYLDRRNNVLKLSQGEFIAVSKLEAVFGDSPLVRQIFIYGNSARAYPLAVVVPSGDALSRHGIENLKPVISESLQEVARAAGLQSYEIPRDFIIETTPFTLENGLLTGIRKLARPQLKKFYGERLERLYTELADSQSNELRELRQSGPDAPVLPTLCRAAAALLGSTAADVRPDAHFADLGGDSLSALSLANLLHEIFGVDVPVGVIVSPASDLRALADHIEAARTGVRRPSFASIHGRSATEVHASDLTLDKFIDAATLAAAPNLPAPSAQVRTVLLTGATGFLGRYLALEWLDRMDLVNGKLICLVRARSDEEAQARLDATFDSGDPYLVRHYRELGAGRLEVLAGDKGEADLGLDRVTWQRLADTVDLIVDPAALVNHVLPYSQLFGPNAAGTAELLRLALTGKRKPYIYTSTIAVGEQIPPEAFTEDADIRAISPTRRIDDSYANGYANSKWAGEVLLREAHEQCGLPVTVFRCDMILADTSYTGQLNLPDMFTRLMLSLAATGIAPGSFYELDAHGNRQRAHYDGLPVEFVAEAICTLGTHSPDRFVTYHVMNPYDDGIGLDEFVDWLNSPTSGSGCTIQRIADYGEWLQRFETSLRALPDRQRHASLLPLLHNYREPAKPICGSIAPTDQFRAAVQEAKIGPDKDIPHLTAAIIAKYISNLRLLGLL

SEQ ID NO: 67 - protein, 1162 aa, Mycobacterium intracellulare
MAATDEQFRNAQPDLSLQQAARQPGLRLPQILELFVEGYADRPAVGWRARTLSTDPATGRTTTRLLPRFDTMTYRELWADVRAIAAAWRHDAANPVSPGDFVATVGFASAEYLTLDLVCGYLGLVAVPLQHNTTPSRLRPIVDEVEPSILAAGVGYLDLAVEAASGSSSLRRLVVFDYQPEVDEQREALQRAQATLAAAGAAVTIETLDEIIERGRALPPEPMYTGDTDQRLAMIMYTSGSTGLPKGAMYTEQMLAKVWTNELMPDFADTPVFNVNFMPLNHLGGRIPLSTAFQAGGTSYFVPESDLSTLFDDWNLVRPTEMGLVPRVAEMLYQRYQSAVDRLVASGADAGSAEARARAELREHVLGGRIVTAFCGTAPLAAEMRAFVETCLDVHVLDGYGLTEVGMVTKDGRMTRPPVLDYKLIDVPELGYFHTDKPYPRGELLVKSLTATPGYFKRPDVTANAFDPDGYYRTGDVMAELEPDRLAYVDRRNNVLKLAQGEFVAVARLEAVFASAPLIRQIFVYGNSERPYLLAVVVPTADAAERFTGDPEGLKAAVAESLRQSAQLAELQSYEVPVDFVVETEPFSEDNGLLSGVGKLLRPKLKERYADRLEQLYAELAENRVTELRALREGADKHPVVFTLTRAAEALLGVAGGPPAPDALFIELGGDSLSALTFSNLLRDIFDVDVPVGMITGPATDLGQLAEYVESERKSGSRRPTFATVHGRGAAEVRAAELTLDKFIDATTLAAAPNLPRATGTPHTVLLTGANGYLGRFLALEWLERLAETGGKLVSIVRATDTAAAVKRLEAVFDSGDPQLLERFRTLAAEHLEVIVGDIGEPNLGLDQATWQRLAQSVDLIVHPAALVNHVLPYDQLFGPNVVGTAELIRLAITTRIKPVTYLSTVAVAMTVDPGEFAEDGDIRAVSAVRPIDDSYANGYANSKWAGEVLLREAHDLCGLPVAVFRSDMILAHSRYAGQLNVPDAFTRLMFSLLTTGIAPTTFYRTDEHGNRAVAHYDGLPADFVAEAVTTLGEQMAAEESGGYRSYDVMNPHDDGVSLDVFVDWLIAAGHDIRRIEDYDEWLGRFTTALRALPDKQRQHSVLPLLDAYREPATPLRGAPAPTDVFRHAVRTAKIGADEDIPHLSAALIDKYVADLRLLGLV

SEQ ID NO: 68 - protein, 1168 aa, Mycobacterium tuberculosis; identical to SEQ ID NO: 55

SEQ ID NO: 69 - protein, 1162 aa, Mycobacterium vanbaalenii
MSTDTREDRLARRIADLYATDPQFAAAAPDDAISHAIDQPGTHLPVIVQTVLDGYAERPALGQRAVRFVTDPATGRTTTELLPRFETITYAELSRRIHAVTAALTDVHPGDRVAVLGFTSIDYTTVDMALAMLGAVAVPLQTSAPATTVRPIVAETEPVVIASSVDALTDAVGLALDAPTVTRLVVFDHRAGVDDHRDALISASDRLRAANSPIEVETITDIVARGSKLPVRAQFSADGDALSLLIYTSGSTGAPKGAMYPQHLVANSWRRLARSFWGDLGVFPAITLNFMPMSHVMGRGLLYGTLDAGGTAYFAARSDLSTFLEDLALVRPTQLSFVPRIWDTIHAEVSQELERRPSDATEVIADLRRSLLGGRYVTAMTGSAPLSPEMRAFVENLLDVHLIDGYGSTEAGAVFVDGRVQRPPVIDYKLVDVADLGYFSTDRPHPRGELLVKSETLFPGYYKRPDVTAEMFDEDGYYRTGDIVAETGADQLTYLDRRNNVLKLSQGEFVTVSRLEAVFGNSPLVRQIYVYGNSARPYLLAVVVPTEAALAGADAKAAVAESLQDVAKATGLQSYEIPRDFLLETTPFTLENGLLTGIRKLARPRLRERYGEQLEALYTMLSEEQADELRELRRSGGERPALETVGRAAGALLGTTAGELEPSAHFTDLGGDSLSALTFANLLRDIFDVDVPVGVIVSPATDLQALADYVESARRHGSVRPTFESVHGHSGRPGTEVHARDLTLDEFVDAATLAHAPTLPGPRAEVRTVLLTGATGFLGRYLALEWLERMALVGGKLICLVRAKDDAAARVRLDSTFDSGDPELLRHYRRLAADHLEVIAGDKADADLGLDARTWQRLADTVDLIVDPAALVNHVLPYRQLFAPNVLGTAELLRIALTTRMKPFVYVSTIGVGAGIEPARFTEDADIRQISATRRIDDSYANGYGNSKWAGEVLLREAHDLCGLPVSVFRCDMILADTTYAGQLNLPDMFTRLIFSLVATGVAPESFYHLATDGTRQRAHYDGLPVEFIAEAISTLGSDVASGFRTYHVMNPHDDGIGLDEYVDWLIDAGHPIRRVGDYPTWLQRFTVAITALPERQRQASLLPLLHNYQHPETPIRGSIAPTDRFREAVQDAKIGPDKDIPHVTPQIVIKYVTDLQRLGLL

SEQ ID NO: 70 - protein, 1174 aa, Mycobacterium sp.
MSTETREARLQQRIAHLFTTDPQFAAARPDPRISDAVDRDDTRLTAIVSAVMSGYADRPALGQRAAEFVTDPQTGRTTMELLPRFDTITYRELLDRVRALTNAWHADGVRPGDRVAILGFTGIDYTVVDLALIQLGAVAVPLQTSAAVEALRPIVAETEPMLIATGVDHVDAAAELALTGHRPSRVVVFDHREQVDDERDAVRAATARLGDAVPVETLAEVLRRGAHLPAVAPHVFDEADPLRLLIYTSGSAGAPKGAMYPESKVAGMWRASAKAAWNNDQTAIPSITLNFLPMSHVMGRGLLCGTLSTGGTAYFAARSDLSTLLEDLRLVRPTQLSFVPRIWDMLFQEFVGEVDRRVNDGADRPTAEADVLAVQRHELLGGRFVTAMTGSAPISLEMKTWVETLLDMHLVEGYGSTEAGAVFVDGHIQRPPVLDYKLVDVPDLGYFSTDRPHPRGELLVRSTQLFPGYYKRPDVTAEVFDDDGFYRTGDIVAEVGPDQVQYLDRRNNVLKLAQGEFVTISKLEAVFAGSALVRQIYVYGNSARSYLLAVVVPTDDAVARHDPASLKTAISASLQQAAKTAGLQSYELPRDFLVETQPFTLENGLLTGIRKLARPKLKARYGDRLEALYVELVEGQAGELRTLRRDGAKRPVAETVGRAAAALLGAAAADVRPDAHFTDLGGDSLSALTFGNLLQEIFGVDVPVGVIVSPAADLASIAAYIEAEQASTGKRPTYASVHGRDAEQVHARDLTLDKFIDAETLSAATELPGPSGEVRTVLLTGATGFLGRYLALDWLERMALVDGKVICLVRAKDDAAARKRLDDTFDSGDPKLLAHYRKLAADHLEVLAGDKGEADLGLPHPVWQRLADTVDLIVDPAALVNHVLPYSQLFGPNALGTAELIRLALTTRIKPFTYVSTIGVGAGIEPGRFTEDDDIRVISPTRAVDTGYANGYGNSKWAGEVLLREAHDLCGLPVAVFRCDMILADTTYAGQLNLPDMFTRMMLSLVTTGIAPKSFHPLDAKGHRQSAHYDGLPVEFVAESISALGAQAVDEAGTGFATYHVMNPHDDGIGLDEFVDWLVEAGYRIDRIDYYAAWLQRFETALRALPERTRQYSLLPLLHNYQRPAHPINGAMAPTDRFRAAVQEAKLGPDKDIPHVTPAVIVKYATDLELLGLI

SEQ ID NO: 71 - protein, 1173 aa, Mycobacterium avium
MSTATHDERLDRRVHELIATDPQFAAAQPDPAITAALEQPGLRLPQIIRTVLDGYADRPALGQRVVEFVTDAKTGRTSAQLLPRFETITYGEVAQRVSALGRALSDDAVHPGDRVCVLGFNSVDYATIDMALGAIGAVSVPLQTSAAISSLQPIVAETEPTLIASSVNQLSDAVQLITGAEQAPTRLVVFDYHPQVDDQREAVQDAAARLSSTGVAVQTLAELLERGKDLPAVGEPPADEDSLALLIYTSGSTGAPKGAMYPQSNVGKMWRRGSKNWFGESAASITLNFMPMSHVMGRSILYGTLGNGGTAYFAARSDLSTLLEDLELVRPTELNFVPRIWETLYGEFQRQVERRLSESGDAGERRAVEAEVLAEQRQYLLGGRFTFAMTGSAPISPELRNWVESLLEMHLMDGYGSTEAGMVLFDGEIQRPPVIDYKLVDVPDLGYFSTDRPHPRGELLLRTENMFPGYYKRAETTAGVFDEDGYYRTGDVFAEIAPDRLVYVDRRNNVLKLAQGEFVTLAKLEAVFGNSPLIRQIYVYGNSAQPYLLAVVVPTEEALASGDPETLKPKIADSLQQVAKEAGLQSYEVPRDFIIETTPFSLENGLLTGIRKLAWPKLKQHYGERLEQMYADLAAGQANELAELRRNGAQAPVLQTVSRAAGAMLGSAASDLSPDAHFTDLGGDSLSALTFGNLLREIFDVDVPVGVIVSPANDLAAIASYIEAERQGSKRPTFASVHGRDATVVRAADLTLDKFLDAETLAAAPNLPKPATEVRTVLLTGATGFLGRYLALEWLERMDMVDGKVIALVRARSDEEARARLDKTFDSGDPKLLAHYQQLAADHLEVIAGDKGEANLGLGQDVWQRLADTVDVIVDPAALVNHVLPYSELFGPNALGTAELIRLALTSKQKPYTYVSTIGVGDQIEPGKFVENADIRQMSATRAINDSYANGYGNSKWAGEVLLREAHDLCGLPVAVFRCDMILADTTYAGQLNLPDMFTRLMLSLVATGIAPGSFYELDADGNRQRAHYDGLPVEFIAAAISTLGSQITDSDTGFQTYHVMNPYDDGIGLDEYVDWLVDAGYSIERIADYSEWLRRFETSLRALPDRQRQYSLLPLLHNYRTPEKPINGSIAPTDVFRAAVQEAKIGPDKDIPHVSPPVIVKYITDLQLLGLL

SEQ ID NO: 72 - protein, 1174 aa, Mycobacterium sp.
MSTETREARLQQRIAHLFATDPQFAAARPDPRISDAVDRDDARLTAIVSAVMSGYADRPALGQRAAEFATDPQTGRTTMELLPRFDTITYRELLDRVRALTNAWHADGVRPGDRVAILGFTGIDYTVVDLALIQLGAVAVPLQTSAAVEALRPIVAETEPMLIATGVDHVDAAAELALTGHRPSQVVVFDHREQVDDERDAVRAATARLGDAVPVETLAEVLRRGAHLPAVAPHVFDEADPLRLLIYTSGSTGAPKGAMYPESKVAGMWRASAKAAWNNDQTAIPSITLNFLPMSHVMGRGLLCGTLSTGGTAYFAARSDLSTLLEDLRLVRPTQLSFVPRIWDMLFQEFVGEVDRRVNDGADRPTAEADVLAELRQELLGGRFVTAMTGSAPISPEMKTWVETLLDMHLVEGYGSTEAGAVFVDGHIQRPPVLDYKLVDVPDLGYFSTDRPHPRGELLVRSTQLFPGYYKRPDVTAEVFDDDGFYRTGDIVAELGPDQLQYLDRRNNVLKLAQGEFVTISKLEAVFAGSALVRQIFVYGNSARSYLLAVVVPTDDAVARHDPASLKTAISASLQQAAKTAGLQSYELPRDFLVETQPFTLENGLLTGIRKLARPKLKARYGDRLEALYVELAEGQAGELRTLRRDGAKRPVAETVGRAAAALLGAAAADVRPDAHFTDLGGDSLSALTFGNLLQEIFGVDVPVGVIVSPAADLASIAAYIETEQASTGKRPTYASVHGRDAEQVRARDLTLDKFIDAETLSAATELPVPIGEVRTVLLTGATGFLGRYLALDWLERMALVDGKVICLVRAKDDAAARKRLDDTFDSGDPKLLAHYRKLAADHLEVLAGDKGEADLGLPHQVWQRLADTVDLIVDPAALVNHVLPYSQLFGPNALGTAELIRLALTTRIKPFTYVSTIGVGAGIEPGRFTEDDDIRVISPTRAVDTGYANGYGNSKWAGEVLLREAHDLCGLPVAVFRCDMILADTTYAGQLNLPDMFTRMMVSLVTTGIAPKSFHPLDAKGHRQRAHYDGLPVEFVAESISALGAQAVDEAGTGFATYHVMNPHDDGIGLDEFVDWLVEAGYRIDRIDDYAAWLQRFETALRALPERTRQYSLLPLLHNYQRPAHPINGAMAPTDRFRAAVQEAKLGPDKDIPHVTPGVIVKYATDLELLGLI

SEQ ID NO: 73 - protein, 95 aa, Mycobacterium leprae
MSTVDGVCDEDIYYYYDCIYCAADVASPTGYLPGGLFSLAKLLVIRGEKQYVFGLNDSTSVGPGPGNMPWLDDPGLSAVIASSVAAAELAAARSW

SEQ ID NO: 74 - protein, 1131 aa, Clavibacter michiganensis
MSTEQMGTEQMGSQHEDTSIEAIFAQHADRTALRQRSGPDITDMGFRELWDRAGALAAALGETVSAGDRIAVLGTATADAVTLDLAAWILGAVSVPLQASAPVAALRAIVEETTPVWIAATADQAATARAVAEASGDGIRTMRLDTDTDADTDTDAALTLGALVARGAGLRRRSPWHPAPGDDPLALLLYTSGSTGTPKGAMYTRSMVERMWHALRPDPAAPADASTTADDGDAAAIVGYAYLPMSHLTGRSSLLATLGRGGTVALATSTDLSTLFDDLRTFAPTEFVFVPRVAELVRQEGDREEQRRLTAGSTDRDAVRAEVQADLRARAFGGRIHRAICTSAPLTPELRTYIEGCLGLTLHDLYGSTEAGGILHDGVIQQPPVTEHKLVDVPELGYRTTDRPHPRGELLVKSASVIAGYFRRPDVTAAVFDEDGFYRTGDVMAQTGPGTYEYVDRRNNVIKLSQGEFVAVASLEATYGGTPEVHQIALHGDSRHAFLVAVVVPADPAASERDILAALQRTAREHGLAPYEVPRGVIVEPDPFTVDGGMLSDAGKLLRLRLTQRYGERLAALYDALEEQQSGTLVAALRERADDEPTVDTVVRAALLLLGAEVSPATAAAARFSDLGGDSLSALTFSGILEDVFGTEVPVGVLTDPTNDLAAVAAYVERSASDDRPTVTRVHGAGASTLRVGDLRLDRMLGGIPTPVPRASAARPGSRTVLLTGANGYLGRFLAIDWLERLAATGGTLVCIVRGADDADARRRLEAAFAADPAFARRFAELSGSLEVLAGDVSEHRLGLDDERWIDLAARVDLVAHAAALVNHVLPYSALFGPNVVGTAEAIRLAIAAGSVPVTFVSSVAVAGGARPGATADAEPSAPGALDEHADIRATIPEWAVGDEYANGYGASKWASEVLLREAHEHHGVPVAVFRSDMILAHPRWRGQVNLPDVFTRLIWSVLTTGLAPASFVRRGPDGERQRSHYDGLPADFTAAAIDGIGAALTEGHRTFNVVNPHDDGVSLDTFVDWIREDGHDIARVDDHAEWVDRFRAALGALPDADRARSVLPLMHAFASPEEPHAGSAIPADAFAEAVRAVRPLGSPDIPSLDHALIAKVADDLAFLGLLAPARAAAA

SEQ ID NO: 75 - protein, 1165 aa, Salinispora arenicola
VTTTEQTLTERLIAEDEQIRRAQVSAEVSAAMRVPGMSQAQIVAAGFTGYADRAALGERAREAVTDPVTGRTTHRLLPWFDTITYGEVRSRVLAISAAWWHDVDAPLRPGAFVVSVGVPSADLVTVELAVLHTGAVSVPLQVSSTAEQLRPILDEAAPLIVATSVDRLAVVTAAMSGNASVRRIMVLNHDAAITAHRDAVDAARSALAGTAVVVHTLTEVLDRGRGLPAPEPYAAPTGEDPLSLLIYTSGSTGTPKGAMFPESMTRANWVRFDPKPTDMAVIRLNYLPLSHNVGRIVLFEALAVGGIAFFTAHSDLSTLLEDMALARPTDLFLIPRLCDMLAQRHDSELARRRITTADHEGVRQVHTHLREAVLGGRVTRAMSLSAPLSPQLRRFVESCLGFAVHDVFGSTEAGGLLVNGRVLRPPVLDYRLVDVPDLGYFTTDRPYPRGELLVRTATIIPGYYQRPELNAELFTEDGYYRTGDIMAEYGPDHLGYVDRTTSVLKLSQGEFVAVSRLEELFAASPLIRQIYLYGNSERPYLLAVVVPTEEAHAATREPAALKAVLGESLQRIAQQHGLHPYEVPRDLLIETTPFSTANGLLSDIRKPLRPKLKTRYAPRLEALYTELAEREADRIRTLRDAGSAQPVLPALREAARAFLGRPGAALDVNDRFVDLGGDSLSALALSNLLSDIFEVRVPVGIMISATGTLGSVAAWIEAERATAGAGIGRATPTSVHGANLTQVHADDLTLGTFLDVTTLAAAACLPRAPLSDPRVVLLTGATGYLGRFLALEWLDRLSRSGGTLVCVVRAADDAEAARRLESVYGSSDPELLERFRSLAGHVRVLAGDVAEARFGLPAGVWQELAETVDLIVHSAALVNHVLPYEQLFGPNVAGTAELVRLAVSVRVKGIAFLSTVAVITSQTTTPDEDADIRQASPHRVLDDSYANGYAASKWAGEVLLRRAHEEYGVPVSVFRSDVILAHSRYAGQLNVPDMFTRLLLSILATGIAPASFYRTGPDGERQPAHYDGLPVDFTAAAVAAVGVTEGHRTFNVLNPHEDGIGLDTFVDWLVAAGHPVQRIADHDEWVTRFATAMRGLPERQRRSSILPLLHAFAEPAPPTFGSRLPTDRFRAAVKAANVVPGNEIPHLDAALVTKYADDLRLLDLL

SEQ ID NO: 76 - protein, 1184 aa, Mycobacterium abscessus
MTVTNETNPQQEQLSRRIESLRESDPQFRAAQPDPAVAEQVLRPGLHLSEAIAALMTGYAERPALGERARELVTDQDGRTTLRLLPRFDTTTYGELWSRTTSVAAAWHHDAAHPVKAGDLVATLGFTSIDYTVLDLAIMILGGVAVPLQTSAPASQWTTILAEAEPNTLAVSIELIGAAMESVRATPSIKQVVVFDYTPEVDDQREAFEAASTQLAGTGIAIETLDAVIARGAALPAAPLYAPSAGDDPLALLIYTSGSTGAPKGAMHSENIVRRWWIREDVMAGTENLPMIGLNFMPMSHIMGRGTLTSTLSTGGTGYFAASSDMSTLFEDMELIRPTALALVPRVCDMVFQRFQTEVDRRLASSDTASAEAVAAEVKADIRDNLFGGRVSAVMVGSAPLSEELGEFIESCFELNLTDGYGSTEAGMVFRDGIVQRPPVIDYKLVDVPELGYFSTDKPHPRGELLLKTDGMFLGYYKRPEVTAGVFDADGFYMTGDIVAELAHDNIEIIDRRNNVLKLSQGEFVAVATLEAEYANSPVVHQIYVYGSSERSYLLAVVVPTPEAVAAAKGDAAALKTTIADSLQDIAKEIQLQSYEVPRDFIIEPQPFTQGNGLLTGIAKLARPNLKAHYGPRLEQMYAEIAEQQAAELRALHGVDPDKPALETVLKAAQALLGVSSAELAADAHFTDLGGDSLSALSFSDLLRDIFAVEVPVGVIVSAANDLSGVAKFVDEQRYSGGTRPTAETVHGAGHTEIRAADLTLDKFIDEATLHAAPSLPKAVGIPHTVLLTGSNGYLGHYLALEWLERLDKTEGKLIAIVRGKNAEAAYRRLEEAFDTGDTQLLAHFRSLADKHLEVLAGDIGDPNLGLDADTWQRLADTVDVIVHPAALVNHVLPYSQLFGPNVVGTAEIIKLAITTKIKPVTYLSTVAVAAYVDPTTFDEESDIRLISAVRPVDELYANGYGNSKWAGEVLLREAHDLCGLPVAVFRSDMILAHSRYTGQLNVPDQFTRLILSLIATGIAPGSFYQAHATGERPLAHYDGLPGDFTAEAITTLGTQVVDSYETYDCVNPHADGVSLDNFVDWLIEAGYPIARIDNYTEWFTRFDTAIRSLPEKQKQHSLLPLLHAFEQPSAAENHGVVPAKRFQHAVQAAGIGPAGQDGTTDIPHLSRRLIVKYAKDLEQLGLL

SEQ ID NO: 77 - protein, 1183 aa, Mycobacterium abscessus
MTIDATADNTKEARRQRLGDRIRRLFTDDEQFRAAKPDTAVDTAVAQPGLRLAQVVATIMNGYADRPALGHRVQELVADAAGRSTLRPLPEFETVTYGELWGMARALASTWYHDPAAPVRAGDFVAMLGFTSVDYTAVDLACIHLGAVAVPLQTSASASNWTAILAESEPAVLAVSAELLDTAMESVLATPSLRHITVFDYHPGVDVQRESLESAQHRIAEAGLPISVDPIPLAIGHGRALPDAPLFTAEEGTDPLALVIYTSGSTGTPKGATYSEKMVAKPWLRADTLSSKAEIPLINLNFMPMSHVMGRGSLVTALACGGLAYFAASSDMSTLFEDITLTRPTVVTLVPRVCDMLFQRYRNEVERRTGLDPAADLATLDADVKTDIRENLFGGRVLTIVCGSAPLSEELAAFIESCLDARITDGYGSTEAGVIVRNGRIQRPPVIDYKLVDVPELGYFSTDKPHPRGELLVKAESVFGGYFKRPDVTADVFDPDGYYKTGDIVAELEPDKIQIVDRRNNVIKLSQGEFVAIANLEAEFANSPLVHQICVYGSSERSYLLAVVVPTAEAYEQSGGDEDLLKRLIADSLAQVAREAQLQSYEVPRDFLLETEPFTAANGLLTGIAKLARPKLHEKYGARLEQLYSDIAAAQALELQALHSAGHEDKPVLDTVQRAVTALLGLSAAEVSPDAHFIDLGGDSLSALAFSDLLRDIFTVEVPVGDIVSAANDLTAIARIVERHREADGHSVTPTAESVHGAGHREIRAADLTLDKFIDADTLRAAPALSTFTGTPHTVLLTGANGYLGRFLALEWLERLDKTDGKLIAIVRGKNAEAAYRRLEEAFDTGDTQLLAHFRSLADKHLEVLAGDIGDPNLGLDADTWQRLAETVDVIVHPAALVNHVLPYSQLFGPNVVGTAEIIKLALTTKIKPITYLSTVAVAISVDPKVFDEDSDIRTISAVRPINDGYANGYGNAKWAGEVLLREAHDLCGLPVAVFRSDMILAHSRYTGQLNVPDQFTRLILSLIATGVAPGSFYQAHATGERPLAHYDGLPADFTASAITALGPIEEFHTYDSVNPHADGISLDNFVDWLIEAGYPIARIDNYTEWFTRFDTAIRSLPEKQKQHSLLPLLHAYRHPQHPHNGAFLPAIRFSEGVQAHLNADIPHLTRELIAKYAADLKQLGLL

SEQ ID NO: 78 - protein, 1163 aa, Mycobacterium abscessus
MTAGAAARVAKLFESDPQFRAAMPDPAVMDSLLAPGLRLSQVLHALLSGYAERPVMGFRSRESVVDTATGRTVDRLLPAFETITYGQLLEDISAILAEWQHGDIPMGAGDFIATIGFSSPDYVTLDLATLMNGSVSIPLQHNTSVAQLRMMLEETSPRLVAASADCLDLAVEAAVGLTDLRRVVVFDYRAETDDHREKLATARERLHAAGMDVVVEPLAEVIGRGRDLPEPVLYTAGDDQRTALIMYTSGSTGAPKGAMFTEWTVTRFWSSGAAPNRDTPIINVNFLPLNHLAGRVGLLTAFIPGGTCYFVPESDLSTLFEDWQLARPTHMGVVPRVVDMLFQHYQTRVDALMAGGTDVDTADRLAKTELREDVLGGRVVAGMLATAPLSPEMKAFLESSLDFHLLDLYGLTEVGGVFRDGKISRPPVLDYKLVDVPELGYYTTDKPHPRGELLVKSATATPGYYKRPDVTAEVFDADGYYRTGDVMAEVAPDQLVYVDRRNNVIKLAQGEFVAVANLETVYVGAPLVRQIFVYGNSERAYLLAVVVPTEEALRAHPDPVELKNSIRESLQRTARSNHLHSYELPADFIIETTPFTIESGMLAAVGKPIRPKMIEHYGDRLEQLYVDLAEARVQELRQLRDTAQQRPVLDTVTEAAQALLGMSADAVRPDHHFIDLGGDSLSALTFSNLLRDLFDVEVPVGVITGPAADLRKLAAYIQHEREHSTATAASVHGLDTTVISATELTLDKFIDAETLHNASQLDVPAGAVATVLLTGANGYLGRFLCLEWLQRLSQTGGQLICLVRGDNADQALARLVAAYGDTDRTLLEEFHTLARRHLRVIAADIAQPRFGVDDATWEQLARDVDKIVHPAALVNHVLPYNQLFGPNVFGTAEVIRLALTTRIKPVTYLSTMAVAMTVPDFDEDGDIRTVSPTRHIDPGYANGYANSKWAGEVLLREAHDICGLPVSVFRSDMILTHRRYSGQLNVTDAFTRMLLSLVLTGIAPRSFYQGDGSGARPRAHYEGLPVDFVTEAITSLGLSSSEGFRSYDVMNPHDDGISVDTFVDWLMEDGHSIDIIDNYDEWLSRFETALRGLPDEQRRASVLPLLDAYRIPGNPRRAAATPNHVFRKAVQENNIGGDGADIPQIDRALIAKYIADLRAHRLL

SEQ ID NO: 79 - protein, 1178 aa, Mycobacterium abscessus
MTETISTAAVPTTDLEEQVKRRIEQVVSNDPQLAALLPEDSVTEAVNEPDLPLVEVIRRLLEGYGDRPALGQRAFEFVTGDDGATVIALKPEYTTVSYRELWERAEAIAAAWHEQGIRDGDFVAQLGFTSTDFASLDVAGLRLGTVSVPLQTGASLQQRNAILEETRPAVFAASIEYLDAAVDSVLATPSVRLLSVFDYHAEVDSQREALEAVRARLESAGRTIVVEALAEALARGRDLPAAPLPSADPDALRLLIYTSGSTGTPKGAMYPQWLVANLWQKKWLTDDVIPSIGVNFMPMSHLAGRLTLMGTLSGGGTAYYIASSDLSTFFEDIALIRPSEVLFVPRVVEMVFQRFQAELDRSLAPGESNSEIAERIKVRIREQDFGGRVLSAGSGSAPLSPEMTEFMESLLQVPLRDGYGSTEAGGVWRDGVLQRPPVTDYKLVDVPELGYFTTDSPHPRGELRLKSETMFPGYYKRPETTADVFDDEGYYKTGDVVAELGPDHLKYLDRVKNVLKLAQGEFVAVSKLEAAYTGSPLVRQIFVYGNSERSFLLAVVVPTPEVLERYADSPDALKPLIQDSLQQVAKDAELQSYEIPRDFIVETVPFTVESGLLSDARKLLRPKLKDHYGERLEALYAELAESQNERLRQLAREAATRPVLETVTDAAAALLGASSSDLAPDVRFIDLGGDSLSALSYSELLRDIFEVDVPVGVINSVANDLAAIARHIEAQRTGAATQPTFASVHGKDATVITAGELTLDKFLDESLLKAAKDVQPATADVKTVLVTGGNGWLGRWLVLDWLERLAPNGGKVYALIRGADAEAARARLDAVYESGDPKLSAHYRQLAQQSLEVIAGDFGDQDLGLSQEVWQKLAKDVDLIVHSGALVNHVLPYSQLFGPNVAGTAEIIKLAISERLKPVTYLSTVGIADQIPVTEFEEDSDVRVMSAERQINDGYANGYGNSKWAGEVLLREAHDLAGLPVRVFRSDMILAHSDYHGQLNVTDVFTRSIQSLLLTGVAPASFYELDADGNRQRAHYDGVPGDFTAASITAIGGVNVVDGYRSFDVFNPHHDGVSMDTFVDWLIDAGYKIARIDDYDQWLARFELALKGLPEQQRQQSVLPLLKMYEKPQPAIDGSALPTAEFSRAVHEAKVGDSGEIPHVTKELILKYASDIQLLGLV

SEQ ID NO: 80 - protein, 1148 aa, Streptomyces griseus
MAEPLDAATASAHDPGQGLAEALAAVEPGRALAEVMASVLEGHGDRPALGERAREPETGRLLPHFDTISYRELWSRVRALAGRWHHDPEYPLGPGDRICTLGFTSTDYATLDLACIHLGAVPVPLPSNAPLPRLAPVVEESGPTVLAASVDRLDTAIDVVLASSTIRRLLVFDDGPGATRPGGALAAARQRLSGSPVTVDTLAGLIDRGRDLPPPPLYIPDPGEDPLALLIYTSGSTGAPKGAMYTQRLLGTAWYGFSYGAADTPAISVLYLPQSHLAGRYAVMGSLVKGGTGYFTAADDLSTLFEDIALVRPTELTMVPRLCDMLLQHYRSERDRRADEPGDIEAAVTKAVREDFLGGRVAKAFVGTAPLSAELTAFVESVLGFHLYTGYGSTEAGGVLLDTVVQRPPVTDYKLVDVPELGYYATDLPHPRGELLLKSHTLIPGYYRRPDLTAAIFDADGYYRTGDVFAETGPDRLVYVDRTKDTLKLSQGEFVAVSRLETVLLDSPLVQHLYLYGNSERAYLLAVVVPTPDALAGCGGDTEALRPLLMESLRSVARRAGLNAYEIPRGILVEPEPFSPENGLFTESHKLLRPRLKERYGPALELLYDRLADGQDRRLRELRRTGADRPVQETVLRAAQALLGSPGSDLRPGAHFTDLGGDSLSAVSFSELMKEIFHVDVPVGAIIGPAADLAEVARYITAARRPAGAPRPTPASVHGEHRTEVRAGDLAPEKFLDAPTLAAAPALPRPDGDVRTVLLTGATGYLGRFLCLEWLERLAPSGGRLVCLVRGSDATVAARRLEAAFDSGDTALLRRYRKAAGKTLDVVAGDIGEPLLGLAEETWRELAGAVDLIVHPAALVNHLLPYGELFGPNVVGTAEAIRLALTTRLKPVNHVSTVAVCLGTPAETADENADIRAAVPVRTTGQGYADGYATSKWAGEVLLREAHERYGLPVAVFRSDMVLAHRTYTGQVNVPDVLTRLLLSLVATGIAPGSFYRTDTRAHYDGLPVDFTAEAVVALGAPITEGHRTFNVLNPHDDGVSLDTFVDWLIEAGHPIRRIDDHGAWLTRFTAALRALPEKQRQHSLLPLIGAWAEPGEGAPGPLLPARRFHAAVRAAGVGPERDIPRVSPDLIRKYVTDLRALGLLAGP

SEQ ID NO: 81 - protein, 1180 aa, Mycobacterium marinum
MSITCVDTRAQRSARRIEQLYSTDAQFAAARPSTAVGIAISKSGLGLPQIIQTVMDGYPQRPALGQRATRVVTDPNTGRSSAQLLAEFETITYRELWNRTNALTNAFAAEALADRGQRVCVLGFASIDYATIDLALMLLGAVSVPLPTNAARAQLCHIVSETQPSLIASSTENLPDAISLVLSHRAPHRVVVFDYRPELDAHREALEAARARLAAIPVTVETLTAIIARGRTVRPAEADCGAQSADAPALLIYTSGSTGAPKGVVYTRNRVADFWRTSKAEVEATEQRTAPSITLNFMPMSHANGRQVLYGTLSNGGTAYFTARSDLSTLFDDLALVRPTELGFPPRIWDMLLERFGREVDRRLRDGTAEGADPGALKARVAADLRQVLLGGRYALAMMGSAPISEQMKASVESLLDLDVMEGYGSTEAGTVIINNEVQRPQVIDYKLVDVAELGYFLTDRPYPRGELLVKTRTLFSGYYRDPEDGAQVFDPDGFYRTGDIMAQVGPDRLAYLDRRNNVLKLSQGEFVAVSRLEAIFANSPLVRQIFVYANGARAYPLAVVVPTQDAQSRHGRAELKAELHTSLHRVAMSAGLAPYEIPRDFIVETTPFTPQNGLLTAIHKLARPHLTQRYGARLELLYTELADSQTRRLHRLRQTGGRLPALETIRRAAGALLGTETTEPRPEAHFKDLGGDSVSAVTFSNLLHDIYGFDVPVGVILGPATDLRALASHVESRRGAGWSGPSFASVHVPRATSVHAGDLKLAKFLDTKTLAAATSLPAADARARTVLLTGATGFLGRYLVLEWLRRLRAVGGKLICLVRAASDEQARVRLDTAFDSGDPQLPEHFRQLAVDRLEVLAGDKSEPGLGLDGPTWQRLADTVDLIVDPATLVNHVLSYRQLFAPNVAGTAELLRLALTTKRKPYAYVSTVSVANQIEPSAFTEDADIREISRTRTIDDSFANGYTTSKWASEVLLREAHDLCGLPVTVFRCDMILADTSYAGQLNLADTFTRLMLSVAATGIAPASFYRLGPDGKRQPAHFDGLPVEFIAEAVATLGARRHDGFQVHHVANPHHDGVGLDEYVDWLVDAGCPIRRIPDYDEWLSRFETALHALPDRKRRHSLLPLLQNYREPAEPIRGGIAPAPRFRGAVRQAKIGRDNDIPHVGPAIIAKYASDLQLLGLA

SEQ ID NO: 82 - protein, 1174 aa, Mycobacterium marinum
MSPITREERLERRIQDLYANDPQFAAAKPATAITAAIERPGLPLPQIIETVMTGYADRPALAQRSVEFVTDAGTGHTTLRLLPHFETISYGELWDRISALADVLSTEQTVKPGDRVCLLGFNSVDYATIDMTLARLGAVAVPLQTSAAITQLQPIVAETQPTMIAASVDALADATELALSGQTATRVLVFDHHRQVDAHRAAVESARERLAGSAVVETLAEAIARGDVPRGASAGSAPGTDVSDDSLALLIYTSGSTGAPKGAMYPRRNVATFWRKRTWFEGGYEPSITLNFMPMSHVMGRQILYGTLCNGGTAYFVAKSDLSTLFEDLALVRPTELTFVPRVWDMVFDEFQSEVDRRLVDGADRVALEAQVKAEIRNDVLGGRYTSALTGSAPISDEMKAWVEELLDMHLVEGYGSTEAGMILIDGAIRRPAVLDYKLVDVPDLGYFLTDRPHPRGELLVKTDSLFPGYYQRAEVTADVFDADGFYRTGDIMAEVGPEQFVYLDRRNNVLKLSQGEFVTVSKLEAVFGDSPLVRQIYIYGNSARAYLLAVIVPTQEALDAVPVEELKARLGDSLQEVAKAAGLQSYEIPRDFIIETTPWTLENGLLTGIRKLARPQLKKHYGELLEQIYTDLAHGQADELRSLRQSGADAPVLVTVCRAAAALLGGSASDVQPDAHFTDLGGDSLSALSFTNLLHEIFDIEVPVGVIVSPANDLQALADYVEAARKPGSSRPTFASVHGASNGQVTEVHAGDLSLDKFIDAATLAEAPRLPAANTQVRTVLLTGATGFLGRYLALEWLERMDLVDGKLICLVRAKSDTEARARLDKTFDSGDPELLAHYRALAGDHLEVLAGDKGEADLGLDRQTWQRLADTVDLIVDPAALVNHVLPYSQLFGPNALGTAELLRLALTSKIKPYSYTSTIGVADQIPPSAFTEDADIRVISATRAVDDSYANGYSNSKWAGEVLLREAHDLCGLPVAVFRCDMILADTTWAGQLNVPDMFTRMILSLAATGIAPGSFYELAADGARQRAHYDGLPVEFIAEAISTLGAQSQDGFHTYHVMNPYDDGIGLDEFVDWLNESGCPIQRIADYGDWLQRFETALRALPDRQRHSSLLPLLHNYRQPERPVRGSIAPTDRFRAAVQEAKIGPDKDIPHVGAPIIVKYVSDLRLLGLL

SEQ ID NO: 83 - protein, 1174 aa, Mycobacterium leprae
MSTITKQEKQLARRVDDLTANDPQFAAAKPDPAVAAALAQPGLRLPQIIQTALDGYAERPALGQRVAEFTKDPKTGRTSMELLPSFETITYRQLGDRVGALARAWRHDLLHAGYRVCVLGFNSVDYAIIDMALGVIGAVAVPLQTSAAITQLQSIVTETEPSMIATSVNQLPDTVELILSGQAPAKLVVFDYHPEVDEQHDAVATARARLADSSVVVESLTEVLGRGKTLPATPIPVADDSADPLALLIYTSGSTGAPKGAMYLQSNVGKMWRRSDGNWFGPTAASITLNFMPMSHVMGRGILYGTLGNGGTAYFAARSDLSTLLEDLKLVRPTELNFVPRIWETLYDESKRAVDRRLANSGSADRAAIKAEVMDEQRQSLLGGRYIAAMTGSAPTSPELKHGVESLLEMHLLEGYGSTEAGMVLFDGEVQRPPVIDYKLVDVPDLGYFSTDQPYPRGELLLKTQNMFPGYYKRPEVTATVFDSDGYYQTGDIVAEVGPDRLVYVDRRNNVLKLAQGQFVTVAKLEAAFSNSPLVRQIYIYGNSAHPYLLAVVVPTEDALATNDIEVLKPLIIDSLQKVAKEADLQSYEVPRDLIVETTPFSLENGLLTGIRKLAWPKLKQHYGARLEQLYADLVEGQANALHVLKQSVANAPVLQTVSRAVGTILGVATTDLPSNAHFTDLGGDSLSALTFGSLLRELFDIDVPVGVIVSPVNNLVAIADYIERERQGTKRPTFIAIHGRDAGKVHASDLTLDKFIDVSTLTAAPVLAQPGTEVRTVLLTGATGFLGRYLALKWLERMDLVEGKVIALVRAKSNEDARARLDKTFDSGDPKLLAHYQELATDHLEVIAGDKGEVDLELDRQTWRRLADTVDLIVDPAALVNHVLPYSELFGPNTLGTAELIRIALTSKQKPYIYVSTIGVGNQIEPAKFTEDSDIRVISPTRNINNNYANGYGNSKWAGEVLLREAHDLCGLPVTVFRCDMILADTSYAGQLNVPDMFTRMMLSLAATGIAPGSFYELDAESNRQRAHYDGLPVEFIAEAISTLGDQSLHDRDGFTTYHVMNPHDDGIGMDEFVDWLIDAGCPIQRINDYDEWLRRFEISLRALPERQRHSSLLPLLHNYQKPEKPLHGSLAPTIRFRTAVQNANIGQDKDIPHISPAIIAKYVSDLQLLGLV

SEQ ID NO: 84 - protein, 1168 aa, Mycobacterium tuberculosis; identical to SEQ ID NO: 55

SEQ ID NO: 85 - protein, 1155 aa, Nocardia farcinica
VESTRATRLRQRIAALYADDAQVRDARPDEAISTALREPGLRLRELVATVVDGYRDRPALAARSVQPAVDAATGACVARLLPEYTTMSYGELGLRLRAVAAAWQHDDETRLRPGEFVATLGFTSPDYAVVDLACVWAGAVAVPLQASASVTQLTAILAETAPAILATGLDTLPHAVDCVLAGATPRALHVFDFDPAIDAQRTVYEAACARLAGTGVRVRTLAEVEDRGRALPPAVIDDGPGDDRLALLIYTSGSTGTPKGAMYTERLVALMWLGQPQVAALTVNYLPLSHVAGRLALFGLLARGGTAYFTARADMSTLFEDLALARPTELFVVPRVCEMVLQRFQTERLRRQADDDRVKADLRLELFGDRLLSVVCGSAPLAPELKAFMESVLDLTLHDGYGSTEAGGSVVIDTTVRRPPVLDYRLADVPELGYFRTDKPHPRGELLLKTTTMIPGYYRRPELNAQIFDEDGFYRTGDVVAELAPDRLVYVDRRNNVLKLAQGEFVTIARLEAIFANSPLVRQIFVYGNSERAYLLAVIVPSRQAMAGDPATLKTRIAESLQLIGRDAELEAYEIPRDFLIETEPFTTESGLLSGIGKILRPAVEARYRDRLEQLYADLAAAQQDELAALRREAGQRPVLETVTRAAAAILGGTASDLSPAAHFTDLGGDSLAALALSNLLREIFAVEVPVGVITGPATDLRGLAAHIAAERENRTETPLFDRVHPDQILIRATDLALEKFFDAEELAAAATAAPPVAEPRVVLLTGANGYLGRFLCLEWLERLDRVDGRLICLVRGADEAAALARLEAAFDSGDPELVRRFKELAQRRLTVVAGDIGEPGLGLATATWRRLAAEVEHIVHPAALVNHVLPYRQLFGPNVAGTAEILRLALTERRKPIDFLSTVAVAAQIPADRFAEDGDIRVISPTRTVDRGYANGYGNSKWAAEVLLRAAHDRFDLPVAVFRSDMILAHGSFAGQLNIPDVFTRLLLSLLVTGIAPASFHAATVTGERPRAHYDGLPADFTAAAITALGARTAGFHTYDVLNPHDDGISLDTFVDWLIEAGHPIERIPEHSEWVTRFETALHALPERQRKHSLLPLLHAYRRPVPALRGSALPAAEFRAAVRAAGITADGDIPHLTRALIEKYVADLRLHGLL

SEQ ID NO: 86 - protein, 1174 aa, Nocardia iowensis; identical to SEQ ID NO: 54

SEQ ID NO: 87 - protein, 1173 aa, Mycobacterium paratuberculosis
MSTATHDERLDRRVHELIATDPQFAAAQPDPAITAALEQPGLRLPQIIRTVLDGYADRPALGQRVVEFVTDAKTGRTSAQLLPRFETITYSEVAQRVSALGRALSDDAVHPGDRVCVLGFNSVDYATIDMALGAIGAVSVPLQTSAAISSLQPIVAETEPTLIASSVNQLSDAVQLITGAEQAPTRLVVFDYHPQVDDQREAVQDAAARLSSTGVAVQTLAELLERGKDLPAVAEPPADEDSLALLIYTSGSTGAPKGAMYPQSNVGKMWRRGSKNWFGESAASITLNFMPMSHVMGRSILYGTLGNGGTAYFAARSDLSTLLEDLELVRPTELNFVPRIWETLYGEFQRQVERRLSEAGDAGERRAVEAEVLAEQRQYLLGGRFTFAMTGSAPISPELRNWVESLLEMHLMDGYGSTEAGMVLFDGEIQRPPVIDYKLVDVPDLGYFSTDRPHPRGELLLRTENMFPGYYKRAETTAGVFDEDGYYRTGDVFAEIAPDRLVYVDRRNNVLKLAQGEFVTLAKLEAVFGNSPLIRQIYVYGNSAQPYLLAVVVPTEEALASGDPETLKPKIADSLQQVAKEAGLQSYEVPRDFIIETTPFSLENGLLTGIRKLAWPKLKQHYGERLEQMYADLAAGQANELAELRRNGAQAPVLQTVSRAAGAMLGSAASDLSPDAHFTDLGGDSLSALTFGNLLREIFDVDVPVGVIVSPANDLAAIASYIEAERQGSKRPTFASVHGRDATVVRAADLTLDKFLDAETLAAAPNLPKPATEVRTVLLTGATGFLGRYLALEWLERMDMVDGKVIALVRARSDEEARARLDKTFDSGDPKLLAHYQQLAADHLEVIAGDKGEANLGLGQDVWQRLADTVDVIVDPAALVNHVLPYSELFGPNALGTAELIRLALTSKQKPYTYVSTIGVGDQIEPGKFVENADIRQMSATRAINDSYANGYGNSKWAGEVLLREAHDLCGLPVAVFRCDMILADTTYAGQLNLPDMFTRLMLSLVATGIAPGSFYELDADGNRQRAHYDGLPVEFIAAAISTLGSQITDSDTGFQTYHVMNPYDDGVGLDEYVDWLVDAGYSIERIADYSEWLRRFETSLRALPDRQRQYSLLPLLHNYRTPEKPINGSIAPTDVFRAAVQEAKIGPDKDIPHVSPPVIVKYITDLQLLGLL

SEQ ID NO: 88 - protein, 1168 aa, Mycobacterium tuberculosis
MSINDQRLTRRVEDLYASDAQFAAASPNEAITQAIDQPGVALPQLIRMVMEGYADRPALGQRALRFVTDPDSGRTMVELLPRFETITYRELWARAGTLATALSAEPAIRPGDRVCVLGFNSVDYTTIDIALIRLGAVSVPLQTSAPVTGLRPIVTETEPTMIATSIDNLGDAVEVLAGHAPARLVVFDYHGKVDTHREAVEAARARLAGSVTIDTLAELIERGRALPATPIADSADDALALLIYTSGSTGAPKGAMYRESQVMSFWRKSSGWFEPSGYPSITLNFMPMSHVGGRQVLYGTLSNGGTAYFVAKSDLSTLFEDLALVRPTELCFVPRIWDMVFAEFHSEVDRRLVDGADRAALEAQVKAELRENVLGGRFVMALTGSAPISAEMTAWVESLLADVHLVEGYGSTEAGMVLNDGMVRRPAVIDYKLVDVPELGYFGTDQPYPRGELLVKTQTMFPGYYQRPDVTAEVFDPDGFYRTGDIMAKVGPDQFVYLDRRNNVLKLSQGEFIAVSKLEAVFGDSPLVRQIFIYGNSARAYPLAVVVPSGDALSRHGIENLKPVISESLQEVARAAGLQSYEIPRDFIIETTPFTLENGLLTGIRKLARPQLKKFYGERLERLYTELADSQSNELRELRQSGPDAPVLPTLCRAAAALLGSTAADVRPDAHFADLGGDSLSALSLANLLHEIFGVDVPVGVIVSPASDLRALADHIEAARTGVRRPSFASIHGRSATEVHASDLTLDKFIDAATLAAAPNLPAPSAQVRTVLLTGATGFLGRYLALEWLDRMDLVNGKLICLVRARSDEEAQARLDATFDSGDPYLVRHYRELGAGRLEVLAGDKGEADLGLDRVTWQRLADTVDLIVDPAALVNHVLPYSQLFGPNAAGTAELLRLALTGKRKPYIYTSTIAVGEQIRPEAFTEDADIRAISPTRRIDDSYANGYANSKWAGEVLLREAHEQCGLPVTVFRCDMILADTSYTGQLNLPDMFTRLMLSLAATGIAPGSFYELDAHGNRQRAHYDGLPVEFVAEAICTLGTHSPDRFVTYHVMNPYDDGIGLDEFVDWLNSPTSGSGCTIQRIADYGEWLQRFETSLRALPDRQRHASLLPLLHNYREPAKPICGSIAPTDQFRAAVQEAKIGPDKDIPHLTAAIIAKYISNLRLLGLL

SEQ ID NO: 89 - protein, 1168 aa, Mycobacterium bovis
MSINDQRLTRRVEDLYASDAQFAAASPNEAITQAIDQPGVALPQLIRMVMEGYADRPALGQRALRFVTDPDSGRTMVELLPRFETITYRELWARAGTLATALSAEPAIRPGDRVCVLGFNSVDYTTIDIALIRLGAVSVPLQTSAPVTGLRPIVTETEPTMIATSIDNLGDAVEVLAGHAPARLVVFDYHGKVDTHREAVEAARARLAGSVTIDTLAELIERGRALPATPIADSADDALALLIYTSGSTGAPKGAMYRESQVMSFWRKSSGWFEPSGYPSITLNFMPMSHVGGRQVLYGTLSNGGTAYYVAKSDLSTLFEDLALVRPTELCFVPRIWDMVFAEFHSEVDRRLVDGADRAALEAQVKAELRENVLGGRFVMALTGSAPISAEMTAWVESLLADVHLVEGYGSTEAGMVLNDGMVRRPAVIDYKLVDVPELGYFGTDQPYPRGELLVKTQTMFPGYYQRPDVTAEVFDPDGFYRTGDIMAKVGPDQFVYLDRRNNVLKLSQGEFIAVSKLEAVFGDSPLVRQIFIYGNSARAYPLAVVVPSGDALSRHGIENLKPVISESLQEVARAAGLQSYEIPRDFIIETTPFTLENGLLTGIRKLARPQLKKFYGERLERLYTELADSQSNELRELRQSGPDAPVLPTLCRAAAALLGSTAADVRPDAHFADLGGDSLSALSLANLLHEIFGVDVPVGVIVSPASDLRALADHIEAARTGVRRPSFASIHGRSATEVHASDLTLDKFIDAATLAAAPNLPAPSAQVRTVLLTGATGFLGRYLALEWLDRMDLVNGKLICLVRARSDEEAQARLDATFDSGDPYLVRHYRELGAGRLEVLAGDKGEADLGLDRVTWQRLADTVDLIVDPAALVNHVLPYSQLFGPNAAGTAELLRLALTGKRKPYIYTSTIAVGEQIPPEAFTEDADIRAISPTRRIDDSYANGYANSKWAGEVLLREAHEQCGLPVTVFRCDMILADTSYTGQLNLPDMFTRLMLSLAATGIAPGSFYELDAHGNRQRAHYDGLPVEFVAEAICTLGTHSPDRFVTYHVMNPYDDGIGLDEFVDWLNSPTSGSGCTIQRIADYGEWLQRFETSLRALPDRQRHTSLLPLLHNYREPAKPICGSIAPTDQFRAAVQEAKIGPDKDIPHLTAAIIAKYISNLRLLGLL

SEQ ID NO: 90 - protein, 1188 aa, Mycobacterium leprae
VWRQQSISHRKESVMSTITKQEKQLARRVDDLTANDPQFAAAKPDPAVAAALAQPGLRLPQIIQTALDGYAERPALGQRVAEFTKDPKTGRTSMELLPSFETITYRQLGDRVGALARAWRHDLLHAGYRVCVLGFNSVDYAIIDMALGVIGAVAVPLQTSAAITQLQSIVTETEPSMIATSVNQLPDTVELILSGQAPAKLVVFDYHPEVDEQHDAVATARARLADSSVVVESLTEVLGRGKTLPATPIPVADDSADPLALLIYTSGSTGAPKGAMYLQSNVGKMWRRSDGNWFGPTAASITLNFMPMSHVMGRGILYGTLGNGGTAYFAARSDLSTLLEDLKLVRPTELNFVPRIWETLYDESKRAVDRRLANSGSADRAAIKAEVMDEQRQSLLGGRYIAAMTGSAPTSPELKHGVESLLEMHLLEGYGSTEAGMVLFDGEVQRPPVIDYKLVDVPDLGYFSTDQPYPRGELLLKTQNMFPGYYKRPEVTATVFDSDGYYQTGDIVAEVGPDRLVYVDRRNNVLKLAQGQFVTVAKLEAAFSNSPLVRQIYIYGNSAHPYLLAVVVPTEDALATNDIEVLKPLIIDSLQKVAKEADLQSYEVPRDLIVETTPFSLENGLLTGIRKLAWPKLKQHYGARLEQLYADLVEGQANALHVLKQSVANAPVLQTVSRAVGTILGVATTDLPSNAHFTDLGGDSLSALTFGSLLRELFDIDVPVGVIVSPVNNLVAIADYIERERQGTKRPTFIAIHGRDAGKVHASDLTLDKFIDVSTLTAAPVLAQPGTEVRTVLLTGATGFLGRYLALKWLERMDLVEGKVIALVRAKSNEDARARLDKTFDSGDPKLLAHYQELATDHLEVIAGDKGEVDLELDRQTWRRLADTVDLIVDPAALVNHVLPYSELFGPNTLGTAELIRIALTSKQKPYIYVSTIGVGNQIEPAKFTEDSDIRVISPTRNINNNYANGYGNSKWAGEVLLREAHDLCGLPVTVFRCDMILADTSYAGQLNVPDMFTRMMLSLAATGIAPGSFYELDAESNRQRAHYDGLPVEFIAEAISTLGDQSLHDRDGFTTYHVMNPHDDGIGMDEFVDWLIDAGCPIQRINDYDEWLRRFEISLRALPERQRHSSLLPLLHNYQKPEKPLHGSLAPTIRFRTAVQNANIGQDKDIPHISPAIIAKYVSDLQLLGLV

SEQ ID NO: 91 - protein, 1271 aa, Dictyostelium discoideum
MLKHIKNFLTRKEERKEKEVEKLKDGVSITEVKQSNLVVYSCNGCGSEIWPPKQERYACNECSNFDLCSECYRKEMILINGTQEEKDKLVSGESNNGIKYEPVRHYDPSPLPHQLTLENETQFQLVYSLRGNSTFETMEKSFKYFKNRPCLGIRERLGEDNVLSERYKWLTYGEVYEKSLTLAKALTNFIERRDFISIYMDNCLEWYFTDFASLWAGLIVVPLHHASNSFNLLEILWNSESKCIVCSGESFKNLIELYDQLTEQDKLEKPIVLKLIVHKEDLFDQSLVDRLPSGVEFKTFNEMIKIGESLSQAKYEFVPVGPNDLSSVTYTSGSTGVPKGVMKLDSIFNLLIVNSYVQFPNAVYSYNTLSHSQRLSDWRYIYMGGRVAIYSGDMNLLFEDLALVRPHSFWAVPRFWNLLFTQFKSDLKQYMFENPQLDERTATLYCYKGIRKLLGDRINNLVTGGAPTANEVLKFMSDCWKDINISNSYGLTEVSGVCIDGYISDEVEFKIEPVPSFGYYPTDLPHPRGELVVKSSTMSAGYYKNTQLTSESFEGGWFKTGDVVELIGVRKVKIIDRIKHAFKLANGEFVTPEPLENNFVSLCINQIFIYGNSLKTFLVAIVKPSQDCLKQLGLQDIPIDQLIENPTLKSKLLSEINKISKEKKLANYEIPKIITIDFTEWTIDNKLITGSGKFNRGELYKFYKIKINNMFDIIDKIQQGLRNNNNNNNNDNINNNDNNNNNESNKDNFENYIKSILNLDGRIEDNNFNLENLSFIQIGGDSLGAVKLSSLLKEKENIDISPSTILNQNFNLSSLSKLINEKESNQSIVEDFKENFKINWNEEMILDEDIKKSIDQIKNAQPSSTPSSSKSTPSQSSSSPPPSLNSNNIGQNAFHMKSIFITGVTGYLGTFLLFNLLEDKSIGIERIYCLVRNVKNEEEGFKLIERIFEKSCINGMNEKIREKVIPVCGDLSKPFFGVSTETFKMLSLAVDMVIHNGAIVNMAYPYANMKSTNVTSTRDILRLCTTGRASFKKLVYVSTVGVFFGNGDEKIDESTAPSTFFLDHGNGYNQTKLISDILVREAASYGLPTMIFRPGTIFSHTQSGFNNQNDSIGLIIKGILGSSSYPTKKDYSSGDLNLSPVDWVSSSMVSLIKHLPFWCNNTKIYHMVNDNRLSLDLLCQYINKEKQLEEINYFDWIDAQLNSSNNPLYSIKHLFKKNDRFPIGSQSIKNPKTIKDLESIGELQCQPISDSTVINYVKYLISNNLIQTINK

SEQ ID NO: 92 - protein, 1110 aa, Streptomyces rimosus
MTDTYVSSRPLSKRPQVPGARTPAPGYPRDSRIPELFEAQAAALPQAPAARHGDRTLTYGQLDAHADALADRLAAGGVRPGDLIGVCGSRSLEALVALLGILKAGCAYVPLDEELPPARLRAMAEDAGISAAVTLPGSTRRVRGLRVSVEVGSLGRPAPERASGPAPDRATGSAADCAYVAFTSGTTGRPKPVALSHRGVVRLVLSDPGLTPPGPGDGVLHAYSLSSDASTIEIWGALLTGACLVVADREELLSPTALERLLRAGGVTVAYLTTSVFHLVARTRPEALAGLRFVSAGGEAMDPRLANAVLAACPRTTVVNFYGPTENAVVSTAHVLTPLPEDAAHVPLGRPFGASTCHVLRADGSPARPGEEGELYVGGDGLALGYLGDPQLTAERFVTLPAVEPDGPLYRTGDRAVRHADGLLEYRGRLDRQVKLRGARIELDEVETRLRAHPEVGEAAVEVDGHSLTAYVTATVPGRPLPLADLRAYCAKWLPPQAVPALIPLDRFPVTSGGKIDRSRLKPTAPPPGPEDTAEAARRPDEPEATDGLSGLLSEVWHQVLRVRPTPRDDFFLLGGDSLLASETVTRTLAVLGLDAALGSTLIRALLAAPTLESFTAAVRGVRGGTGGPAGGQEPAVDFAAETGLGFALPPAEGPAPNPHDPEDVLLTGASGFVGGFLLHRLLHATAARVHCPVRATSPAHARQRVRTALTRYGLHLDEADWQRVECFPGDLTQPRLGLDHERADALAQRLDLIVHNGARVNFLYPYQQLRPANVDGTREVVRIAARRRVPVHFVSTVAVVAGFGTAGVREVDEDLPPAHADGLTMGYAESKWVAEGVLRQAAAQGLPVAVYRPYEVTGDRTHGACNTETAICSLFKMIADTGVAPDIKLPMDFVPVDHLAESLVHIATHRPADGRVYHLTNPRPAMLSDVLDRMRAAGFTLRTLPYDAWVGELVRHVAENPTSATAPFVSLCVDRSRTADMSVKEMYLKGTFPVLGRRNAEEALAGSGLHCPPVDSALLDRYLEYFFTSGYLTRPAAGPGPESEAERIPEDEPVSGTEPISGTEPISAAEPISGTEPISAAGPISGTEPIPAAEPISGTAAAARTERSR

SEQ ID NO: 93 - protein, 1168 aa, Mycobacterium tuberculosis
MSINDQRLTRRVEDLYASDAQFAAASPNEAITQAIDQPGVALPQLIRMVMEGYADRPALGQRALRFVTDPDSGRTMVELLPRFETITYRELWARAGTLATALSAEPAIRPGDRVCVLGFNSVDYTTIDIALIRLGAVSVPLQTSAPVTGLRPIVTETEPTMIATSIDNLGDAVEVLAGHAPARLVVFDYHGKVDTHREAVEAARARLAGSVTIDTLAELIERGRALPATPIADSADDALALLTYTSGSTGAPKGAMYRESQVMSFWRKSSGWFEPSGYPSITLNFMPMSHVGGRQVLYGTLSNGGTAYFVAKSDLSTLFEDLALVRPTELCFVPRIWDMVFAEFHSEVDRRLVDGADRAALEAQVKAELRENVLGGRFVMALTGSAPISAEMTAWVESLLADVHLVEGYGSTEAGMVLNDGMVRRPAVIDYKLVDVPELGYFGTDQPYPRGELLVKTQTMFPGYYQRPDVTAEVFDPDGFYRTGDIMAKVGPDQFVYLDRRNNVLKLSQGEFIAVSKLEAVFGDSPLVRQIFIYGNSARAYPLAVVVPSGDALSRHGIENLKPVISESLQEVARAAGLQSYEIPRDFIIETTPFTLENGLLTGIRKLARPQLKKFYGERLERLYTELADSQSNELRELRQSGPDAPVLPTLCRAAAALLGSTAADVRPDAHFADLGGDSLSALSLANLLHEIFGVDVPVGVIVSPASDLRALADHIEAARTGVRRPSFASIHGRSATEVHASDLTLDKFIDAATLAAAPNLPAPSAQVRTVLLTGATGFLGRYLALEWLDRMDLVNGKLICLVRARSDEEAQARLDATFDSGDPYLVRHYRELGAGRLEVLAGDKGEADLGLDRVTWQRLADTVDLIVDPAALVNHVLPYSQLFGPNAAGTAELLRLALTGKRKPYIYTSTIAVGEQIPPEAFTEDADIRAISPTRRIDDSYANGYANSKWAGEVLLREAHEQCGLPVTVFRCDMILADTSYTGQLNLPDMFTRLMLSLAATGIAPGSFYELDAHGNRQRAHYDGLPVEFVAEAICTLGTHSPDRFVTYHVMNPYDDGIGLDEFVDWLNSPTSGSGCTIQRIADYGEWLQRFETSLRALPDRQRHASLLPLLHNYREPAKPICGSIAPTDQFRAAVQEAKIGPDKDIPHLTAAIIAKYISNLRLLGLL

SEQ ID NO: 94 - protein, 1093 aa, Mycobacterium tuberculosis
MVELLPRFETITYRELWARAGTLATALSAEPAIRPGDRVCVLGFNSVDYTTIDIALIRLGAVSVPLQTSAPVTGLRPIVTETEPTMIATSIDNLGDAVEVLAGHAPARLVVFDYHGKVDTHREAVEAARARLAGSVTIDTLAELIERGRALPATPIADSADDALALLIYTSGSTGAPKGAMYRESQVMSFWRKSSGWFEPSGYPSITLNFMPMSHVGGRQVLYGTLSNGGTAYFVAKSDLSTLFEDLALVRPTELCFVPRIWDMVFAEFHSEVDRRLVDGADRAALEAQVKAELRENVLGGRFVMALTGSAPISAEMTAWVESLLADVHLVEGYGSTEAGMVLNDGMVRRPAVIDYKLVDVPELGYFGTDQPYPRGELLVKTQTMFPGYYQRPDVTAEVFDPDGFYRTGDIMAKVGPDQFVYLDRRNNVLKLSQGEFIAVSKLEAVFGDSPLVRQIFIYGNSARAYPLAVVVPSGDALSRHGIENLKPVISESLQEVARAAGLQSYEIPRDFIIETTPFTLENGLLTGIRKLARPQLKKFYGERLERLYTELADSQSNELRELRQSGPDAPVLPTLCRAAAALLGSTAADVRPDAHFADLGGDSLSALSLANLLHEIFGVDVPVGVIVSPASDLRALADHIEAARTGVRRPSFASIHGRSATEVHASDLTLDKFIDAATLAAAPNLPAPSAQVRTVLLTGATGFLGRYLALEWLDRMDLVNGKLICLVRARSDEEAQARLDATFDSGDPYLVRHYRELGAGRLEVLAGDKGEADLGLDRVTWQRLADTVDLIVDPAALVNHVLPYSQLFGPNAAGTAELLRLALTGKRKPYIYTSTIAVGEQIPPEAFTEDADIRAISPTRRIDDSYANGYANSKWAGEVLLREAHEQCGLPVTVFRCDMILADTSYTGQLNLPDMFTRLMLSLAATGIAPGSFYELDAHGNRQRAHYDGLPVEFVAEAICTLGTHSPDRFVTYHVMNPYDDGIGLDEFVDWLNSPTSGSGCTIQRIADYGEWLQRFETSLRALPDRQRHASLLPLLHNYREPAKPICGSIAPTDQFRAAVQEAKIGPDKDIPHLTAAIIAKYISNLRLLGLL

SEQ ID NO: 95 - protein, 1041 aa, Mycobacterium tuberculosis
DIALIRLGAVSVPLQTSAPVTGLRPIVTETEPTMIATSIDNLGDAVEVLAGHAPARLVVFDYHGKVDTHREAVEAARARLAGSVTIDTLAELIERGRALPATPIADSADDALALLIYTSGSTGAPKGAMYRESQVMSFWRKSSGWFEPSGYPSITLNFMPMSHVGGRQVLYGTLSNGGTAYFVAKSDLSTLFEDLALVRPTELCFVPRIWDMVFAEFHSEVDRRLVDGADRAALEAQVKAELRENVLGGRFVMALTGSAPISAEMTAWVESLLADVHLVEGYGSTEAGMVLNDGMVRRPAVIDYKLVDVPELGYFGTDQPYPRGELLVKTQTMFPGYYQRPDVTAEVFDPDGFYRTGDIMAKVGPDQFVYLDRRNNVLKLSQGEFIAVSKLEAVFGDSPLVRQIFIYGNSARAYPLAVVVPSGDALSRHGIENLKPVISESLQEVARAAGLQSYEIPRDFIIETTPFTLENGLLTGIRKLARPQLKKFYGERLERLYTELADSQSNELRELRQSGPDAPVLPTLCRAAAALLGSTAADVRPDAHFADLGGDSLSALSLANLLHEIFGVDVPVGVIVSPASDLRALADHIEAARTGVRRPSFASIHGRSATEVHASDLTLDKFIDAATLAAAPNLPAPSAQVRTVLLTGATGFLGRYLALEWLDRMDLVNGKLICLVRARSDEEAQARLDATFDSGDPYLVRHYRELGAGRLEVLAGDKGEADLGLDRVTWQRLADTVDLIVDPAALVNHVLPYSQLFGPNAAGTAELLRLALTGKRKPYIYTSTIAVGEQIPPEAFTEDADIRAISPTRRIDDSYANGYANSKWAGEVLLREAHEQCGLPVTVFRCDMILADTSYTGQLNLPDMFTRLMLSLAATGIAPGSFYELDAHGNRQRAHYDGLPVEFVAEAICTLGTHSPDRFVTYHVMNPYDDGIGLDEFVDWLNSPTSGSGCTIQRIADYGEWLQRFETSLRALPDRQRHASLLPLLHNYREPAKPICGSIAPTDQFRAAVQEAKIGPDKDIPHLTAAIIAKYISNLRLLGLL

SEQ ID NO: 96 - protein, 1000 aa, Mycobacterium tuberculosis
MSINDQRLTRRVEDLYASDAQFAAASPNEAITQAIDQPGVALPQLIRMVMEGYADRPALGQRALRFVTDPDSGRTMVELLPRFETITYRELWARAGTLATALSAEPAIRPGDRVCVLGFNSVDYTTIDIALIRLGAVSVPLQTSAPVTGLRPIVTETEPTMIATSIDNLGDAVEVLAGHAPARLVVFDYHGKVDTHREAVEAARARLAGSVTIDTLAELIERGRALPATPIADSADDALALLIYTSGSTGAPKGAMYRESQVMSFWRKSSGWFEPSGYPSITLNFMPMSHVGGRQVLYGTLSNGGTAYFVAKSDLSTLFEDLALVRPTELCFVPRIWDMVFAEFHSEVDRRLVDGADRAALEAQVKAELRENVLGGRFVMALTGSAPISAEMTAWVESLLADVHLVEGYGSTEAGMVLNDGMVRRPAVIDYKLVDVPELGYFGTDQPYPRGELLVKTQTMFPGYYQRPDVTAEVFDPDGFYRTGDIMAKVGPDQFVYLDRRNNVLKLSQGEFIAVSKLEAVFGDSPLVRQIFIYGNSARAYPLAVVVPSGDALSRHGIENLKPVISESLQEVARAAGLQSYEIPRDFIIETTPFTLENGLLTGIRKLARPQLKKFYGERLERLYTELADSQSNELRELRQSGPDAPVLPTLCRAAAALLGSTAADVRPDAHFADLGGDSLSALSLANLLHEIFGVDVPVGVIVSPASDLRALADHIEAARTGVRRPSFASIHGRSATEVHASDLTLDKFIDAATLAAAPNLPAPSAQVRTVLLTGATGFLGRYLALEWLDRMDLVNGKLICLVRARSDEEAQARLDATFDSGDPYLVRHYRELGAGRLEVLAGDKGEADLGLDRVTWQRLADTVDLIVDPAALVNHVLPYSQLFGPNAAGTAELLRLALTGKRKPYIYTSTIAVGEQIPPEAFTEDADIRAISPTRRIDDSYANGYANSKWAGEVLLREAHEQCGLPVTVFRCDMILGRHQLYRSAQPAGHVTRADAEPG

SEQ ID NO: 97 - protein, 1174 aa, Mycobacterium intracellulare; identical to SEQ ID NO: 63

SEQ ID NO: 98 - protein, 339 aa, Escherichia coli
MSMIKSYAAKEAGGELEVYEYDPGELRPQDVEVQVDYCGICHSDLSMIDNEWGFSQYPLVAGHEVIGRVVALGSAAQDKGLQVGQRVGIGWTARSCGHCDACISGNQINCEQGAVPTIMNRGGFAEKLRADWQWVIPLPENIDIESAGPLLCGGITVFKPLLMHHITATSRVGVIGIGGLGHIAIKLLHAMGCEVTAFSSNPAKEQEVLAMGADKVVNSRDPQALKALAGQFDLIINTVNVSLDWQPYFEALTYGGNFHTVGAVLTPLSVPAFTLIAGDRSVSGSATGTPYELRKLMRFAARSKVAPTTELFPMSKINDAIQHVRDGKARYRVVLKADF

SEQ ID NO: 99 - protein, 349 aa, Escherichia coli
MKIKAVGAYSAKQPLEPMDITRREPGPNDVKIEIAYCGVCHSDLHQVRSEWAGTVYPCVPGHEIVGRVVAVGDQVEKYAPGDLVGVGCIVDSCKHCEECEDGLENYCDHMTGTYNSPTPDEPGHTLGGYSQQIVVHERYVLRIRHPQEQLAAVAPLLCAGITTYSPLRHWQAGPGKKVGVVGIGGLGHMGIKLAHAMGAHVVAFTTSEAKREAAKALGADEVVNSRNADEMAAHLKSFDFILNTVAAPHNLDDFTTLLKRDGTMTLVGAPATPHKSPEVFNLIMKRRAIAGSMIGGIPETQEMLDFCAEHGIVADIEMIRADQINEAYERMLRGDVKYRFVIDNRTLTD

SEQ ID NO: 100 - protein, 336 aa, Escherichia coli
MKAAVVTKDHHVDVTYKTLRSLKHGEALLKMECCGVCHTDLHVKNGDFGDKTGVILGHEGIGVVAEVGPGVTSLKPGDRASVAWFYEGCGHCEYCNSGNETLCRSVKNAGYSVDGGMAEECIVVADYAVKVPDGLDSAAASSITCAGVTTYKAVKLSKIRPGQWIAIYGLGGLGNLALQYAKNVFNAKVIAIDVNDEQLKLATEMGADLAINSHTEDAAKIVQEKTGGAHAAVVTAVAKAAFNSAVDAVRAGGRVVAVGLPPESMSLDIPRLVLDGIEVVGSLVGTRQDLTEAFQFAAEGKVVPKVALRPLADINTIFTEMEEGKIRGRMVIDFRH

SEQ ID NO: 101 - protein, 358 aa, Escherichia coli
MKALARFGKAFGGYKMIDVPQPMCGPEDVVIEIKAAAICGADMKHYNVDSGSDEFNSIRGHEFAGCIAQVGEKVKDWKVGQRVVSDNSGHVCGVCPACEQGDFLCCTEKVNLGLDNNTWGGGFSKYCLVPGEILKIHRHALWEIPDGVDYEDAAVLDPICNAYKSIAQQSKFLPGQDVVVIGTGPLGLFSVQMARIMGAVNIVVVGLQEDVAVRFPVAKELGATAVVNGSTEDVVARCQQICGKDNLGLVIECSGANIALKQAIEMLRPNGEVVRVGMGFKPLDFSINDITAWNKSIIGHMAYDSTSWRNAIRLLASGAIKVKPMITHRIGLSQWREGFDAMVDKTAIKVIMTYDFDE

SEQ ID NO: 102 - protein, 347 aa, Escherichia coli
MKNSKAILQVPGTMKIISAEIPVPKEDEVLIKVEYVGICGSDVHGFESGPFIPPKDPNQEIGLGHECAGTVVAVGSRVRKFKPGDRVNIEPGVPCGHCRYCLEGKYNICPDVDFMATQPNYRGALTHYLCHPESFTYKLPDNMDTMEGALVEPAAVGMHAAMLADVKPGKKIIILGAGCIGLMTLQACKCLGATEIAVVDVLEKRLAMAEQLGATVVINGAKEDTIARCQQFTEDMGADIVFETAGSAVTVKQAPYLVMRGGKIMIVGTVPGDSAINFLKINREVTIQTVFRYANRYPVTIEAISSGRFDVKSMVTHIYDYRDVQQAFEESVNNKRDIIKGVIKISD

SEQ ID NO: 103 - protein, 343 aa, Escherichia coli
MQVKTQSCVVAGKKTVAVTEQTIDWNNNGTLVQITRGGICGSDLHYYQEGKVGNFMIKAPMVLGHEVIGKVIHSDSSELHEGQTVAINPSKPCGHCKYCIEHNENQCTDMRFFGSAMYFPHVDGGFTRYKMVETSQCVPYPAKADEKVMAFAEPLAVAIHAAHQAGELQGKRVFISGVGPIGCLIVSAVKTLGAAEIVCADVSPRSLSLGKEMGADVLVNPQNDDMDHWKAEKGYFDVSFEVSGHPSSVNTCLEVTRARGVMVQVGMGGAMAEFPMMTLIGKEISLRGSFRFTSEFNTAVSWLANGVINPLPLLSAEYPFTDLEEALRFAGDKTQAAKVQLVF

SEQ ID NO: 104 - protein, 341 aa, Escherichia coli
MKALSKLKAEEGIWMTDVPVPELGHNDLLIKIRKTAICGTDVHIYNWDEWSQKTIPVPMVVGHEYVGEVVGIGQEVKGFKIGDRVSGEGHITCGHCRNCRGGRTHLCRNTIGVGVNRPGCFAEYLVIPAFNAFKIPDNISDDLAAIFDPFGNAVHTALSFDLVGEDVLVSGAGPIGIMAAAVAKHVGARNVVITDVNEYRLELARKMGITRAVNVAKENLNDVMAELGMTEGFDVGLEMSGAPPAFRTMLDTMNHGGRIAMLGIPPSDMSIDWTKVIFKGLFIKGIYGREMFETWYKMAALIQSGLDLSPIITHRFSIDDFQKGFDAMRSGQSGKVILSWD

SEQ ID NO: 105 - protein, 340 aa, Escherichia coli
MSTMNVLICQQPKELVWKQREIPIPGDNEALIKIKSVGICGTDIHAWGGNQPFFSYPRVLGHEICGEIVGLGKNIADLKNGQQVAVIPYVACQQCPACKSGRTNCCEKISVIGVHQDGGFSEYLSVPVANILPADGIDPQAAALIEPFAISAHAVRRAAIAPGEQVLVVGAGPIGLGAAAIAKADGAQVVVADTSPARREHVATRLELPLLDPSAEDFDAQLRAQFGGSLAQKVIDATGNQHAMNNTVNLIRHGGTVVFVGLFKGELQFSDPEFHKKETTMMGSRNATPEDFAKVGRLMAEGKITADMMLTHRYPFATLAETYERDVINNRELIKGVITF

SEQ ID NO: 106 - protein, 339 aa, Escherichia coli
MKSILIEKPNQLAIVEREIPTPSAGEVRVKVKLAGICGSDSHIYRGHNPFAKYPRVIGHEFFGVIDAVGEGVESARVGERVAVDPVVSCGHCYPCSIGKPNVCTTLAVLGVHADGGFSEYAVVPAKNAWKIPEAVADQYAVMIEPFTIAANVTGHGQPTENDTVLVYGAGPIGLTIVQVLKGVYNVKNVIVADRIDERLEKAKESGADWAINNSQTPLGEIFTEKGIKPTLIIDAACHPSILKEAVTLASPAARIVLMGFSSEPSEVIQQGITGKELSIFSSRLNANKFPIVIDWLSKGLIKPEKLITHTFDFQHVADAISLFEQDQKHCCKVLLTFSE

SEQ ID NO: 107 - protein, 346 aa, Escherichia coli
MKSVVNDTDGIVRVAESVIPEIKHQDEVRVKIASSGLCGSDLPRIFKNGAHYYPITLGHEFSGYIDAVGSGVDDLHPGDAVACVPLLPCFTCPECLKGFYSQCAKYDFIGSRRDGGFAEYIVVKRKNVFALPTDMPIEDGAFIEPITVGLHAFHLAQGCENKNVIIIGAGTIGLLAIQCAVALGAKSVTAIDISSEKLALAKSFGAMQTFNSSEMSAPQMQSVLRELRFNQLILETAGVPQTVELAVEIAGPHAQLALVGTLHQDLHLTSATFGKILRKELTVIGSWMNYSSPWPGQEWETASRLLTERKLSLEPLIAHRGSFESFAQAVRDIARNAMPGKVLLIP

SEQ ID NO: 108 - protein, 353 aa, Escherichia coli
MKTMLAAYLPGNSTVDLREVAVPTPGINQVLIKMKSSGICGSDVHYIYHQHRATAAAPDKPLYQGFINGHEPCGQIVAMGQGCRHFKEGDRVLVYHISGCGFCPNCRRGFPISCTGEGKAAYGWQRDGGHAEYLLAEEKDLILLPDALSYEDGAFISCGVGTAYEGILRGEVSGSDNVLVVGLGPVGMMAMMLAKGRGAKRIIGVDMLPERLAMAKQLGVMDHGYLATTEGLPQIIAELTHGGADVALDCSGNAAGRLLALQSTADWGRVVYIGETGKVEFEVSADLMHHQRRIIGSWVTSLFHMEKCAHDLTDWKLWPRNAITHRFSLEQAGDAYALMASGKCGKVVINFPD

SEQ ID NO: 109 - protein, 324 aa, Escherichia coli
MQALLLEQQDGKTLASVQTLDESRLPEGDVTVDVHWSSLNYKDALAITGKGKIIRNFPMIPGIDFAGTVRTSEDPRFHAGQEVLLTGWGVGENHWGGLAEQARVKGDWLVAMPQGLDARKAMIIGTAGFTAMLCVMALEDAGVRPQDGEIVVTGASGGVGSTAVALLHKLGYQVVAVSGRESTHEYLKSLGASRVLPRDEFAESRPLEKQVWAGAIDTVGDKVLAKVLAQMNYGGCVAACGLAGGFTLPTTVMPFILRNVRLQGVDSVMTPPERRAQAWQRLVADLPESFYTQAAKEISLSEAPNFAEAIINNQIQGRTLVKVN

SEQ ID NO: 110 - protein, 350 aa, Escherichia coli
MKKLVATAPRVAALVEYEDRAILANEVKIRVRFGAPKHGTEVVDFRAASPFIDEDFNGEWQMFTPRPADAPRGIEFGKFQLGNMVVGDIIECGSDVTDYAVGDSVCGYGPLSETVIINAVNNYKLRKMPQGSSWKNAVCYDPAQFAMSGVRDANVRVGDFVVVVGLGAIGQIAIQLAKRAGASVVIGVDPIAHRCDIARRHGADFCLNPIGTDVGKEIKTLTGKQGADVIIETSGYADALQSALRGLAYGGTISYVAFAKPFAEGFNLGREAHFNNAKIVFSRACSEPNPDYPRWSRKRIEETCWELLMNGYLNCEDLIDPVVTFANSPESYMQYVDQHPEQSIKMGVTF

SEQ ID NO: 111 - protein, 345 aa, Escherichia coli
MGQQKQRNRRWVLASRPHGAPVPENFRLEEDDVATPGEGQVLLRTVYLSLDPYMRGRMSDEPSYSPPVDIGGVMVGGTVSRVVESNHPDYQSGDWVLGYSGWQDYDISSGDDLVKLGDHPQNPSWSLGVLGMPGFTAYMGLLDIGQPKEGETLVVAAATGPVGATVGQIGKLKGCRVVGVAGGAEKCRHATEVLGFDVCLDHHADDFAEQLAKACPKGIDIYYENVGGKVFDAVLPLLNTSARIPVCGLVSSYNATELPPGPDRLPLLMATVLKKRIRLQGFIIAQDYGHRIHEFQREMGQWVKEDKIHYREEITDGLENAPQTFIGLLKGKNFGKVVIRVAGDD

SEQ ID NO: 112 - protein, 327 aa, Escherichia coli
MATRIEFHKHGGPEVLQAVEFTPADPAENEIQVENKAIGINFIDTYIRSGLYPPPSLPSGLGTEAAGIVSKVGSGVKHIKAGDRVVYAQSALGAYSSVHNIIADKAAILPAAISFEQAAASFLKGLTVYYLLRKTYEIKPDEQFLFHAAAGGVGLIACQWAKALGAKLIGTVGTAQKAQSALKAGAWQVINYREEDLVERLKEITGGKKVRVVYDSVGRDTWERSLDCLQRRGLMVSFGNSSGAVTGVNLGILNQKGSLYVTRPSLQGYITTREELTEASNELFSLIASGVIKVDVAEQQKYPLKDAQRAHEILESRATQGSSLLIP

SEQ ID NO: 113 - protein, 369 aa, Escherichia coli
MKSRAAVAFAPGKPLEIVEIDVAPPKKGEVLIKVTHTGVCHTDAFTLSGDDPEGVFPVVLGHEGAGVVVEVGEGVTSVKPGDHVIPLYTAECGECEFCRSGKTNLCVAVRETQGKGLMPDGTTRFSYNGQPLYHYMGCSTFSEYTVVAEVSLAKINPEANHEHVCLLGCGVTTGIGAVHNTAKVQPGDSVAVFGLGAIGLAVVQGARQAKAGRIIAIDTNPKKFDLARRFGATDCINPNDYDKPIKDVLLDINKWGIDHTFECIGNVNVMRAALESAHRGWGQSVIIGVAVAGQEISTRPFQLVTGRVWKGSAFGGVKGRSQLPGMVEDAMKGDIDLEPFVTHTMSLDEINDAFDLMHEGKSIRTVIRY

SEQ ID NO: 114 - protein, 412 aa, Escherichia coli
MKALTYHGPHHVQVENVPDPGVEQADDIILRITATAICGSDLHLYRGKIPQVKHGDIFGHEFMGEVVETGKDVKNLQKGDRVVIPFVIACGDCFFCRLQQYAACENTNAGKGAALNKKQIPAPAALFGYSHLYGGVPGGQAEYVRVPKGNVGPFKVPPLLSDDKALFLSDILPTAWQAAKNAQIQQGSSVAVYGAGPVGLLTIACARLLGAEQIFVVDHHPYRLHFAADRYGAIPINFDEDSDPAQSIIEQTAGHRGVDAVIDAVGFEAKGSTTETVLTNLKLEGSSGKALRQCIAAVRRGGIVSVPGVYAGFIHGFLFGDAFDKGLSFKMGQTHVHAWLGELLPLIEKGLLKPEEIVTHYMPFEEAARGYEIFEKREEECRKVILVPGAQSAEAAQKAVSGLVNAMPGGTI

SEQ ID NO: 115 - protein, 425 aa, Escherichia coli
MKTKVAAIYGKRDVRLRVFELPEITDNELLVSVISDSVCLSTWKAALLGSEHKRVPDDLENHPVITGHECAGVIVEVGKNLTGKYKKGQRFVLQPAMGLPSGYSAGYSYEYFGGNATYMIIPEIAINLGCVLPYHGSYFAAASLAEPMCCIIGAYHANYHTTQYVYEHRMGVKPGGNIALLACAGPMGIGAIDYAINGGIQPSRVVVVDIDDKRLAQVQKLLPVELAASKGIELVYVNTKGMSDPVQMLRALTGDAGFDDIFVYAAVPAVVEMADELLAEDGCLNFFAGPTDKNFKVPFNFYNVHYNSTHVVGTSGGSTDDMKEAIALSATGQLQPSFMVTHIGGLDAVPETVLNLPDIPGGKKLIYNGVTMPLTAIADFAEKGKTDPLFKELARLVEETHGIWNEQAEKYLLAQFGVDIGEAAQ

SEQ ID NO: 116 - protein, 383 aa, Escherichia coli
MAASTFFIPSVNVIGADSLTDAMNMMADYGFTRTLIVTDNMLTKLGMAGDVQKALEERNIFSVIYDGTQPNPTTENVAAGLKLLKENNCDSVISLGGGSPHDCAKGIALVAANGGDIRDYEGVDRSAKPQLPMIAINTTAGTASEMTRFCIITDEARHIKMAIVDKHVTPLLSVNDSSLMIGMPKSLTAATGMDALTHAIEAYVSIAATPITDACALKAVTMIAENLPLAVEDGSNAKAREAMAYAQFLAGMAFNNASLGYVHAMAHQLGGFYNLPHGVCNAVLLPHVQVFNSKVAAARLRDCAAAMGVNVTGKNDAEGAEACINAIRELAKKVDIPAGLRDLNVKEEDFAVLATNALKDACGFTNPIQATHEEIVAIYRAAM

SEQ ID NO: 117 - protein, 383 aa, Escherichia coli
MMANRMILNETAWFGRGAVGALTDEVKRRGYQKALIVTDKTLVQCGVVAKVTDKMDAAGLAWAIYDGVVPNPTITVVKEGLGVFQNSGADYLIAIGGGSPQDTCKAIGIISNNPEFADVRSLEGLSPTNKPSVPILAIPTTAGTAAEVTINYVITDEEKRRKFVCVDPHDIPQVAFIDADMMDGMPPALKAATGVDALTHAIEGYITRGAWALTDALHIKAIEIIAGALRGSVAGDKDAGEEMALGQYVAGMGFSNVGLGLVHGMAHPLGAFYNTPHGVANAILLPHVMRYNADFTGEKYRDIARVMGVKVEGMSLEEARNAAVEAVFALNRDVGIPPHLRDVGVRKEDIPALAQAALDDVCTGGNPREATLEDIVELYHTAW

SEQ ID NO: 118 - protein, 395 aa, Escherichia coli
MQNELQTALFQAFDTLNLQRVKTFSVPPVTLCGPGSVSSCGQQAQTRGLKHLFVMADSFLHQAGMTAGLTRSLTVKGIAMTLWPCPVGEPCITDVCAAVAQLRESGCDGVIAFGGGSVLDAAKAVTLLVTNPDSTLAEMSETSVLQPRLPLIAIPTTAGTGSETTNVTVIIDAVSGRKQVLAHASLMPDVAILDAALTEGVPSHVTAMTGIDALTHAIEAYSALNATPFTDSLAIGAIAMIGKSLPKAVGYGHDLAARESMLLASCMAGMAFSSAGLGLCHAMAHQPGAALHIPHGLANAMLLPTVMEFNRMVCRERFSQIGRALRTKKSDDRDAINAVSELIAEVGIGKRLGDVGATSAHYGAWAQAALEDICLRSNPRTASLEQIVGLYAAAQ

SEQ ID NO: 119 - protein, 387 aa, Escherichia coli
MNNFNLHTPTRILFGKGAIAGLREQIPHDARVLITYGGGSVKKTGVLDQVLDALKGMDVLEFGGIEPNPAYETLMNAVKLVREQKVTFLLAVGGGSVLDGTKFIAAAANYPENIDPWHILQTGGKEIKSAIPMGCVLTLPATGSESNAGAVISRKTTGDKQAFHSAHVQPVFAVLDPVYTYTLPPRQVANGVVDAFVHTVEQYVTKPVDAKIQDRFAEGILLTLIEDGPKALKEPENYDVRANVMWAATQALNGLIGAGVPQDWATHMLGHELTAMHGLDHAQTLAIVLPALWNEKRDTKRAKLLQYAERVWNITEGSDDERIDAAIAATRNFFEQLGVPTHLSDYGLDGSSIPALLKKLEEHGMTQLGENHDITLDVSRRIYEAAR

SEQ ID NO: 120 - protein, 891 aa, Escherichia coli
MAVTNVAELNALVERVKKAQREYASFTQEQVDKIFRAAALAAADARIPLAKMAVAESGMGIVEDKVIKNHFASEYIYNAYKDEKTCGVLSEDDTFGTITIAEPIGIICGIVPTTNPTSTAIFKSLISLKTRNAIIFSPHPRAKDATNKAADIVLQAAIAAGAPKDLIGWIDQPSVELSNALMHHPDINLILATGGPGMVKAAYSSGKPAIGVGAGNTPVVIDETADIKRAVASVLMSKTFDNGVICASEQSVVVVDSVYDAVRERFATHGGYLLQGKELKAVQDVILKNGALNAAIVGQPAYKIAELAGFSVPENTKILIGEVTVVDESEPFAHEKLSPTLAMYRAKDFEDAVEKAEKLVAMGGIGHTSCLYTDQDNQPARVSYFGQKMKTARILINTPASQGGIGDLYNFKLAPSLTLGCGSWGGNSISENVGPKHLINKKTVAKRAENMLWHKLPKSIYFRRGSLPIALDEVITDGHKRALIVTDRFLFNNGYADQITSVLKAAGVETEVFFEVEADPTLSIVRKGAELANSFKPDVIIALGGGSPMDAAKIMWVMYEHPETHFEELALRFMDIRKRIYKFPKMGVKAKMIAVTTTSGTGSEVTPFAVVTDDATGQKYPLADYALTPDMAIVDANLVMDMPKSLCAFGGLDAVTHAMEAYVSVLASEFSDGQALQALKLLKEYLPASYHEGSKNPVARERVHSAATIAGIAFANAFLGVCHSMAHKLGSQFHIPHGLANALLICNVIRYNANDNPTKQTAFSQYDRPQARRRYAEIADHLGLSAPGDRTAAKIEKLLAWLETLKAELGIPKSIREAGVQEADFLANVDKLSEDAFDDQCTGANPRYPLISELKQILLDTYYGRDYVEGETAAKKEAAPAKAEKKAKKSA

SEQ ID NO: 121 - protein, 267 aa, Escherichia coli
MAIPAFGLGTFRLKDDVVISSVITALELGYRAIDTAQIYDNEAAVGQAIAESGVPRHELYITTKIWIENLSKDKLIPSLKESLQKLRTDYVDLTLIHWPSPNDEVSVEEFMQALLEAKKQGLTREIGISNFTIPLMEKAIAAVGAENIATNQIELSPYLQNRKVVAWAKQHGIHITSYMTLAYGKALKDEVIARIAAKHNATPAQVILAWAMGEGYSVIPSSTKRKNLESNLKAQNLQLDAEDKKAIAALDCNDRLVSPEGLAPEWD

SEQ ID NO: 122 - protein, 326 aa, Escherichia coli
MKKIPLGTTDITLSRMGLGTWAIGGGPAWNGDLDRQICIDTILEAHRCGINLIDTAPGYNFGNSEVIVGQALKKLPREQVVVETKCGIVWERKGSLFNKVGDRQLYKNLSPESIREEVAASLQRLGIDYIDIYMTHWQSVPPFFTPIAETVAVLNELKSEGKIRAIGAANVDADHIREYLQYGELDIIQAKYSILDRAMENELLPLCRDNGIVVQVYSPLEQGLLTGTITRDYVPGGARANKVWFQRENMLKVIDMLEQWQPLCARYQCTIPTLALAWILKQSDLISILSGATAPEQVRENVAALNINLSDADATLMREMAEALER

SEQ ID NO: 123 - protein, 284 aa, Escherichia coli
MQQKMIQFSGDVSLPAVGQGTWYMGEDASQRKTEVAALRAGIELGLTLIDTAEMYADGGAEKVVGEALTGLREKVFLVSKVYPWNAGGQKAINACEASLRRLNTDYLDLYLLHWSGSFAFEETVAAMEKLIAQGKIRRWGVSNLDYADMQELWQLPGGNQCATNQVLYHLGSRGIEYDLLPWCQQQQMPVMAYSPLAQAGRLRNGLLKNAVVNEIAHAHNISAAQVLLAWVISHQGVMAIPKAATIAHVQQNAAVLEVELSSAELAMLDKAYPAPKGKTALDMV

SEQ ID NO: 124 - protein, 275 aa, Escherichia coli
MANPTVIKLQDGNVMPQLGLGVWQASNEEVITAIQKALEVGYRSIDTAAAYKNEEGVGKALKNASVNREELFITTKLWNDDHKRPREALLDSLKKLQLDYIDLYLMHWPVPAIDHYVEAWKGMIELQKEGLIKSIGVCNFQIHHLQRLIDETGVTPVINQIELHPLMQQRQLHAWNATHKIQTESWSPLAQGGKGVFDQKVIRDLADKYGKTPAQIVIRWHLDSGLVVIPKSVTPSRIAENFDVWDFRLDKDELGEIAKLDQGKRLGPDPDQFGG

SEQ ID NO: 125 - protein, 324 aa, Escherichia coli [sequence omitted]

SEQ ID NO: 126 - protein, 346 aa, Escherichia coli
MVWLANPERYGQMQYRYCGKSGLRLPALSLGLWHNFGHVNALESQRAILRKAFDLGITHFDLANNYGPPPGSAEENFGRLLREDFAAYRDELIISTKAGYDMWPGPYGSGGSRKYLLASLDQSLKRMGLEYVDIFYSHRVDENTPMEETASALAHAVQSGKALYVGISSYSPERTQKMVELLREWKIPLLIHQPSYNLLNRWVDKSGLLDTLQNNGVGCIAFTPLAQGLLTGKYLNGIPQDSRMHREGNKVRGLTPKMLTEANLNSLRLLNEMAQQRGQSMAQMALSWLLKDDRVTSVLIGASRAEQLEENVQALNNLTFSTKELAQIDQHIADGELNLWQASSDK

SEQ ID NO: 127 - protein, 346 aa, Escherichia coli
MQYHRIPHSSLEVSTLGLGTMTFGEQNSEADAHAQLDYAVAQGINLIDVAEMYPVPPRPETQGLTETYVGNWLAKHGSREKLIIASKVSGPSRNNDKGIRPDQALDRKNIREALHDSLKRLQTDYLDLYQVHWPQRPTNCFGKLGYSWTDSAPAVSLLDTLDALAEYQRAGKIRYIGVSNETAFGVMRYLHLADKHDLPRIVTIQNPYSLLNRSFEVGLAEVSQYEGVELLAYSCLGFGTLTGKYLNGAKPAGARNTLFSRFTRYSGEQTQKAVAAYVDIARRHGLDPAQMALAFVRRQPFVASTLLGATTMDQLKTNIESLHLELSEDVLAEIEAVHQVYTYPAP

SEQ ID NO: 128 - protein, 286 aa, Escherichia coli
MSSNTFTLGTKSVNRLGYGAMQLAGPGVFGPPRDRHVAITVLREALALGVNHIDTSDFYGPHVTNQIIREALYPYSDDLTIVTKIGARRGEDASWLPAFSPAELQKAVHDNLRNLGLDVLDVVNLRVMMGDGHGPAEGSIEASLTVLAEMQQQGLVKHIGLSNVTPTQVAEARKIAEIVCVQNEYNIAHRADDAMIDALAHDGIAYVPFFPLGGFTPLQSSTLSDVAASLGATPMQVALAWLLQRSPNILLIPGTSSVAHLRENMAAEKLHLSEEVLSTLDGISRE

SEQ ID NO: 129 - protein, 269 aa, Escherichia coli
MTHKATEILTGKVMQKSVLITGCSSGIGLESALELKRQGFHVLAGCRKPDDVERMNSMGFTGVLIDLDSPESVDRAADEVIALTDNCLYGIFNNAGFGMYGPLSTISRAQMEQQFSANFFGAHQLTMRLLPAMLPHGEGRIVMTSSVMGLISTPGRGAYAASKYALEAWSDALRMELRHSGIKVSLIEPGPIRTRFTDNVNQTQSDKPVENPGIAARFTLGPEAVVDKVRHAFISEKPKMRYPVTLVTWAVMVLKRLLPGRVMDKILQG

SEQ ID NO: 130 - protein, 253 aa, Escherichia coli
MAQVAIITASDSGIGKECALLLAQQGFDIGITWHSDEEGAKDTAREVVSHGVRAEIVQLDLGNLPEGALALEKLIQRLGRIDVLVNNAGAMTKAPFLDMAFDEWRKIFTVDVDGAFLCSQIAARQMVKQGQGGRIINITSVHEHTPLPDASAYTAAKHALGGLTKAMALELVRHKILVNAVAPGAIATPMNGMDDSDVKPDAEPSIPLRRFGATHEIASLVVWLCSEGANYTTGQSLIVDGGFMLANPQFNPE

SEQ ID NO: 131 - protein, 252 aa, Escherichia coli
MHYQPKQDLLNDRIILVTGASDGIGREAAMTYARYGATVILLGRNEEKLRQVASHINEETGRQPQWFILDLLTCTSENCQQLAQRIAVNYPRLDGVLHNAGLLGDVCPMSEQNPQVWQDVMQVNVNATFMLTQALLPLLLKSDAGSLVFTSSSVGRQGRANWGAYAASKFATEGMMQVLADEYQQRLRVNCINPGGTRTAMRASAFPTEDPQKLKTPADIMPLYLWLMGDDSRRKTGMTFDAQPGRKPGISQ

SEQ ID NO: 132 - protein, 247 aa, Escherichia coli
MAIALVTGGSRGIGRATALLLAQEGYTVAVNYQQNLHAAQEVMNLITQAGGKAFVLQADISDENQVVAMFTAIDQHDEPLAALVNNAGILFTQCTVENLTAERINRVLSTNVTGYFLCCREAVKRMALKNGGSGGAIVNVSSVASRLGSPGEYVDYAASKGAIDTLTTGLSLEVAAQGIRVNCVRPGFIYTEMHASGGEPGRVDRVKSNIPMQRGGQAEEVAQAIVWLLSDKASYVTGSFIDLAGGK

SEQ ID NO: 133 - protein, 237 aa, Escherichia coli
MGAFTGKTVLILGGSRGIGAAIVRRFVTDGANVRFTYAGSKDAAKRLAQETGATAVFTDSADRDAVIDVVRKSGALDILVVNAGIGVFGEALELNADDIDRLFKINIHAPYHASVEAARQMPEGGRILIIGSVNGDRMPVAGMAAYAASKSALQGMARGLARDFGPRGITINVVQPGPIDTDANPANGPMRDMLHSLMAIKRHGQPEEVAGMVAWLAGPEASFVTGAMHTIDGAFGA

SEQ ID NO: 134 - protein, 248 aa, Escherichia coli
MIVLVTGATAGFGECITRRFIQQGHKVIATGRRQERLQELKDELGDNLYIAQLDVRNRAAIEEMLASLPAEWCNIDILVNNAGLALGMEPAHKASVEDWETMIDTNNKGLVYMTRAVLPGMVERNHGHIINIGSTAGSWPYAGGNVYGATKAFVRQFSLNLRTDLHGTAVRVTDIEPGLVGGTEFSNVRFKGDDGKAEKTYQNTVALTPEDVSEAVWWVSTLPAHVNINTLEMMPVTQSYAGLNVHRQ

SEQ ID NO: 135 - protein, 261 aa, Escherichia coli
MSIESLNAFSMDFFSLKGKTAIVTGGNSGLGQAFAMALAKAGANIFIPSFVKDNGETKEMIEKQGVEVDFMQVGITAEGAPQKIIAACCERFGTVDILVNNAGICKLNKVLDFGRADWDPMIDVNLTAAFELSYEAAKIMIPQKSGKIINICSLFSYLGGQWSPAYSATKHALAGFTKAYCDELGQYNIQVNGIAPGYYATDITLATRSNPETNQRVLDHIPANRWGDTQDLMGAAVFLASPASNYVNGHLLVVDGGYLVR

SEQ ID NO: 136 - protein, 263 aa, Escherichia coli
MGKLTGKTALITGALQGIGEGIARTFARHGANLILLDISPEIEKLADELCGRGHRCTAVVADVRDPASVAAAIKRAKEKEGRIDILVNNAGVCRLGSFLDMSDDDRDFHIDINIKGVWNVTKAVLPEMIARKDGRIVMMSSVTGDMVADPGETAYALTKAAIVGLTKSLAVEYAQSGIRVNAICPGYVRTPMAESIARQSNPEDPESVLTEMAKAIPMRRLADPLEVGELAAFLASDESSYLTGTQNVIDGGSTLPETVSVGI

SEQ ID NO: 137 - protein, 248 aa, Escherichia coli
MDFSGKNVWVTGAGKGIGYATALAFVEAGAKVTGFDQAFTQEQYPFATEVMDVADAAQVAQVCQRLLAETERLDALVNAAGILRMGATDQLSKEDWQQTFAVNVGGAFNLFQQTMNQFRRQRGGAIVTVASDAAHTPRIGMSAYGASKAALKSLALSVGLELAGSGVRCNVVSPGSTDTDMQRTLWVSDDAEEQRIRGFGEQFKLGIPLGKIARPQEIANTILFLASDLASHITLQDIVVDGGSTLGA

SEQ ID NO: 138 - protein, 240 aa, Escherichia coli
MGKTQPLPILITGGGRRIGLALAWHFINQKQPVIVSYRTHYPAIDGLINAGAQCIQADFSTNDGVMAFADEVLKSTHGLRAILHNASAWMAEKPGAPLADVLACMMQIHVNTPYLLNHALERLLRGHGHAASDIIHFTDYVVERGSDKHIAYAASKAALDNMTRSFARKLAPEVKVNSIAPSLILFNEHDDAEYRQQALNKSLMKTAPGEKEVIDLVDYLLTSCFVTGRSFPLDGGRHLR

SEQ ID NO: 139 - protein, 255 aa, Escherichia coli
MFNSDNLRLDGKCAIITGAGAGIGKEIAITFATAGASVVVSDINADAANHVVDEIQQLGGQAFACRCDITSEQELSALADFAISKLGKVDILVNNAGGGGPKPFDMPMADFRRAYELNVFSFFHLSQLVAPEMEKNGGGVILTITSMAAENKNINMTSYASSKAAASHLVRNMAFDLGEKNIRVNGIAPGAILTDALKSVITPEIEQKMLQHTPIRRLGQPQDIANAALFLCSPAASWVSGQILTVSGGGVQELN

SEQ ID NO: 140 - protein, 270 aa, Escherichia coli
MSDLHNESIFITGGGSGLGLALVERFIEEGAQVATLELSAAKVASLRQRFGEHILAVEGNVTCYADYQRAVDQILTRSGKLDCFIGNAGIWDHNASLVNTPAETLETGFHELFNVNVLGYLLGAKACAPALIASEGSMIFTLSNAAWYPGGGGPLYTASKHAATGLIRQLAYELAPKVRVNGVGPCGMASDLRGPQALGQSETSIMQSLTPEKIAAILPLQFFPQPADFTGPYVMLTSRRNNRALSGVMINADAGLAIRGIRHVAAGLDL

SEQ ID NO: 141 - protein, 259 aa, Escherichia coli
MNQVAVVIGGGQTLGAFLCHGLAAEGYRVAVVDIQSDKAANVAQEINAEYGESMAYGFGADATSEQSVLALSRGVDEIFGRVDLLVYSAGIAKAAFISDFQLGDFDRSLQVNLVGYFLCAREFSRLMIRDGIQGRIIQINSKSGKVGSKHNSGYSAAKFGGVGLTQSLALDLAEYGITVHSLMLGNLLKSPMFQSLLPQYATKLGIKPDQVEQYYIDKVPLKRGCDYQDVLNMLLFYASPKASYCTGQSINVTGGQVMF

SEQ ID NO: 142 - protein, 253 aa, Escherichia coli
MILSAFSLEGKVAVVTGCDTGLGQGMALGLAQAGCDIVGINIVEPTETIEQVTALGRRFLSLTADLRKIDGIPALLDRAVAEFGHIDILVNNAGLIRREDALEFSEKDWDDVMNLNIKSVFFMSQAAAKHFIAQGNGGKIINIASMLSFQGGIRVPSYTASKSGVMGVTRLMANEWAKHNINVNAIAPGYMATNNTQQLRADEQRSAEILDRIPAGRWGLPSDLMGPIVFLASSASDYVNGYTIAVDGGWLAR

SEQ ID NO: 143 - protein, 254 aa, Escherichia coli
MNDLFSLAGKNILITGSAQGIGFLLATGLGKYGAQIIINDITAERAELAVEKLHQEGIQAVAAPFNVTHKHEIDAAVEHIEKDIGPIDVLVNNAGIQRRHPFTEFPEQEWNDVIAVNQTAVFLVSQAVTRHMVERKAGKVINICSMQSELGRDTITPYAASKGAVKMLTRGMCVELARHNIQVNGIAPGYFKTEMTKALVEDEAFTAWLCKRTPAARWGDPQELIGAAVFLSSKASDFVNGHLLFVDGGMLVAV

SEQ ID NO: 144 - protein, 244 aa, Escherichia coli
MNFEGKIALVTGASRGIGRAIAETLAARGAKVIGTATSENGAQAISDYLGANGKGLMLNVTDPASIESVLEKIRAEFGEVDILVNNAGITRDNLLMRMKDEEWNDIIETNLSSVFRLSKAVMRAMMKKRHGRIITIGSVVGTMGNGGQANYAAAKAGLIGFSKSLAREVASRGITVNVVAPGFIETDMTRALSDDQRAGILAQVPAGRLGGAQEIANAVAFLASDEAAYITGETLHVNGGMYMV

SEQ ID NO: 145 - protein, 262 aa, Escherichia coli
MGFLSGKRILVTGVASKLSIAYGIAQAMHREGAELAFTYQNDKLKGRVEEFAAQLGSDIVLQCDVAEDASIDTMFAELGKVWPKFDGFVHSIGFAPGDQLDGDYVNAVTREGFKIAHDISSYSFVAMAKACRSMLNPGSALLTLSYLGAERAIPNYNVMGLAKASLEANVRYMANAMGPEGVRVNAISAGPIRTLAASGIKDFRKMLAHCEAVTPIRRTVTIEDVGNSAAFLCSDLSAGISGEVVHVDGGFSIAAMNELELK

SEQ ID NO: 146 - protein, 183 aa, Escherichia coli
MDALELLINRRSASRLAEPAPTGEQLQNILRAGMRAPDHKSMQPWHFFVIEGEGRERFSAVLEQGAIAAGSDDKAIDKARNAPFRAPLIITVVAKCEENHKVPRWEQEMSAGCAVMAMQMAAVAQGFGGIWRSGALTESPVVREAFGCREQDKIVGFLYLGTPQLKASTSINVPDPTPFVTYF

SEQ ID NO: 147 - protein, 340 aa, Acinetobacter sp.
MTTNVIHAYAAMQAGEALVPYSFDAGELQPHQVEVKVEYCGLCHSDVSVLNNEWHSSVYPVVAGHEVIGTITQLGSEAKGLKIGQRVGIGWTAESCQACDQCISGQQVLCTGENTATIIGHAGGFADKVRAGWQWVIPLPDELDPTSAGPLLCGGITVFDPILKHQIQAIHHVAVIGIGGLGHMAIKLLKAWGCEITAFSSNPNKTDELKAMGADHVVNSRDDAEIKSQQGKFDLLLSTVNVPLNWNAYLNTLAPNGTFHFLGVVMEPIPVPVGALLGGAKSLTASPTGSPAALRKLLEFAARKNIAPQIEMYPMSELNEAIERLHSGQARYRIVLKADF

SEQ ID NO: 148 - protein, 341 aa, Synechococcus elongatus
MFGLIGHLTSLEQARDVSRRMGYDEYADQGLEFWSSAPPQIVDEITVTSATGKVIHGRYIESCFLPEMLAARRFKTATRKVLNAMSHAQKHGIDISALGGFTSIIFENFDLASLRQVRDTTLEFERFTTGNTHTAYVICRQVEAAAKTLGIDITQATVAVVGATGDIGSAVCRWLDLKLGVGDLILTARNQERLDNLQAELGRGKILPLEAALPEADFIVWVASMPQGVVIDPATLKQPCVLIDGGYPKNLGSKVQGEGIYVLNGGVVEHCFDIDWQIMSAAEMARPERQMFACFAEAMLLEFEGWHTNFSWGRNQITIEKMEAIGEASVRHGFQPLALAI

SEQ ID NO: 149 - protein, 340 aa, Synechocystis sp.
MFGLIGHLTSLEHAQAVAEDLGYPEYANQGLDFWCSAPPQVVDNFQVKSVTGQVIEGKYVESCFLPEMLTQRRIKAAIRKILNAMALAQKVGLDITALGGFSSIVFEEFNLKQNNQVRNVELDFQRFTTGNTHTAYVICRQVESGAKQLGIDLSQATVAVCGATGDIGSAVCRWLDSKHQVKELLLIARNRQRLENLQEELGRGKIMDLETALPQADIIVWVASMPKGVEIAGEMLKKPCLIVDGGYPKNLDTRVKADGVHILKGGIVEHSLDITWEIMKIVEMDIPSRQMFACFAEAILLEFEGWRTNFSWGRNQISVNKMEAIGEASVKHGFCPLVAL

SEQ ID NO: 150 - protein, 340 aa, Cyanothece sp.
MFGLIGHLTSLEHAHSVADAFGYGPYATQGLDLWCSAPPQFVEHFHVTSITGQTIEGKYIESAFLPEMLIKRRIKAAIRKILNAMAFAQKNNLNITALGGFSSIIFEEFNLKENRQVRNVSLEFDRFTTGNTHTAYIICRQVEQASAKLGIDLSQATVAICGATGDIGSAVCRWLDRKTDTQELFLIARNKERLQRLQDELGRGKIMGLEEALPEADIIVWVASMPKGVEINAETLKKPCLIIDGGYPKNLDTKIKHPDVHILKGGIVEHSLDIDWKIMETVNMDVPSRQMFACFAEAILLEFEQWHTNFSWGRNQITVTKMEQIGEASVKHGLQPLLSW

SEQ ID NO: 151 - protein, 346 aa, Prochlorococcus marinus
MFGLIGHSTSFEDAKRKASLLGFDHIADGDLDVWCTAPPQLVENVEVKSAIGISIEGSYIDSCFVPEMLSRFKTARRKVLNAMELAQKKGINITALGGFTSIIFENFNLLQHKQIRNTSLEWERFTTGNTHTAWVICRQLEMNAPKIGIDLKSATVAVVGATGDIGSAVCRWLINKTGIGELLLVARQKEPLDSLQKELDGGTIKNLDEALPEADIVVWVASMPKTMEIDANNLKQPCLMIDGGYPKNLDEKFQGNNIHVVKGGIVRFFNDIGWNMMELAEMQNPQREMFACFAEAMILEFEKCHTNFSWGRNNISLEKMEFIGAASVKHGFSAIGLDKHPKVLAV

SEQ ID NO: 152 - protein, 350 aa, Gloeobacter violaceus
MFGLIGHLTNLSHAQRVARDLGYDEYASHDLEFWCMAPPQAVDEITITSVTGQVIHGQYVESCFLPEMLAQGRFKTAMRKILNAMALVQKRGIDITALGGFSSIIFENFSLDKLLNVRDITLDIQRFTTGNTHTAYILCQQVEQGAVRYGIDPAKATVAVVGATGDIGSAVCRWLTDRAGIHELLLVARDAERLDRLQQELGTGRILPVEEALPKADIVVWVASMNQGMAIDPAGLRTPCLLIDGGYPKNMAGTLQRPGIHILDGGMVEHSLDIDWQIMSFLNVPNPARQFFACFAESMLLEFEGLHFNFSWGRNHITVEKMAQIGSLSKKHGFRPLLEPSQRSGELVHG

SEQ ID NO: 153 - protein, 339 aa, Nostoc punctiforme
MFGLIGHLTSLEHAQAVAQELGYPEYADQGLDFWCSAPPQIVDSIIVTSVTGQQIEGRYVESCFLPEMLASRRIKAATRKILNAMAHAQKHGINITALGGFSSIIFENFKLEQFSQVRNIKLEFERFTTGNTHTAYIICKQVEEASKQLGINLSNATVAVCGATGDIGSAVTRWLDARTDVQELLLIARDQERLKELQGELGRGKIMGLTEALPQADVVVWVASMPRGVEIDPTTLKQPCLLIDGGYPKNLATKIQYPGVHVLNGGIVEHSLDIDWKIMKIVNMDVPARQLFACFAESMLLEFEKLYTNFSWGRNQITVDKMEQIGRVSVKHGFRPLLV

SEQ ID NO: 154 - protein, 339 aa, Anabaena variabilis
MFGLIGHLTSLEHAQAVAQELGYPEYADQGLDFWCSAPPQIVDHIKVTSITGEIIEGRYVESCFLPEMLASRRIKAATRKVLNAMAHAQKHGIDITALGGFSSIIFENFKLEQFSQVRNVTLEFERFTTGNTHTAYIICRQVEQASQQLGIELSQATVAICGATGDIGSAVTRWLDAKTDVKELLLIARNQERLQELQSELGRGKIMSLDEALPQADIVVWVASMPKGVEINPQVLKQPCLLIDGGYPKNLGTKVQYPGVYVLNGGIVEHSLDIDWKIMKIVNMDVPARQLFACFAESMLLEFEKLYTNFSWGRNQITVDKMEQIGQASVKHGFRPLLV

SEQ ID NO: 155 - protein, 340 aa, Synechococcus elongatus
MFGLIGHLTSLEQARDVSRRMGYDEYADQGLEFWSSAPPQIVDEITVTSATGKVIHGRYIESCFLPEMLAARRFKTATRKVLNAMSHAQKHGIDISALGGFTSIIFENFDLASLRQVRDTTLEFERFTTGNTHTAYVICRQVEAAAKTLGIDITQATVAVVGATGDIGSAVCRWLDLKLGVGDLILTARNQERLDNLQAELGRGKILPLEAALPEADFIVWVASMPQGVVIDPATLKQPCVLIDGGYPKNLGSKVQGEGIYVLNGGVVEHCFDIDWQIMSAAEMARPERQMFACFAEAMLLEFEGWHTNFSWGRNQITIEKMEAIGEASVRHGFQPLALA

SEQ ID NO: 156 - protein, 339 aa, Nostoc sp.
MFGLIGHLTSLEHAQAVAQELGYPEYADQGLDFWCSAPPQIVDHIKVTSITGEIIEGRYVESCFLPEMLASRRIKAATRKVLNAMAHAQKNGIDITALGGFSSIIFENFKLEQFSQVRNVTLEFERFTTGNTHTAYIICRQVEQASQQLGIELSQATVAICGATGDIGSAVTRWLDAKTDVKELLLIARNQERLQELQSELGRGKIMSLDEALPQADIVVWVASMPKGVEINPQVLKQPCLLIDGGYPKNLGTKVQYPGVYVLNGGIVEHSLDIDWKIMKIVNMDVPARQLFACFAESMLLEFEKLYTNFSWGRNQITVDKMEQIGQASVKHGFRPLLV

SEQ ID NO: 157 - DNA, 657 bp, Artificial Sequence
  Description of Artificial Sequence: Synthetic polynucleotide
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcg

SEQ ID NO: 158 - DNA, 564 bp, Artificial Sequence
  Description of Artificial Sequence: Synthetic polynucleotide
ttagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgc

SEQ ID NO: 159 - DNA, 70 bp, Artificial Sequence
  Description of Artificial Sequence: Synthetic oligonucleotide
cagacgatggtgcaggatatcctgctgatgaagcagaacaactttaacgccgtgcgctgttcgcattatc

SEQ ID NO: 160 - DNA, 1085 bp, Artificial Sequence
  Description of Artificial Sequence: Synthetic polynucleotide
atgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgttaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtga

The invention claimed is:

1. A method of producing a fatty acid ester, the method comprising: culturing a recombinant bacterium genetically engineered to express an exogenous ester synthase (EC 2.3.1.75) having at least 90% sequence identity to SEQ ID NO: 18 and having an amino acid substitution at the residue corresponding to glycine 395 of SEQ ID NO: 18 in culture medium comprising a carbon source, under conditions effective to express the ester synthase, wherein said ester synthase has an increased enzymatic activity relative to that of SEQ ID NO: 18.

2. The method of claim 1, further comprising culturing the recombinant bacterium in the presence of an alcohol.

3. The method of claim 1, wherein the fatty acid ester comprises a fatty acid ethyl ester (FAEE), a fatty acid methyl ester (FAME), or an ester of a long chain alcohol.

4. The method of claim 1, wherein the recombinant bacterium is *E. coli* or a cyanobacteria.

5. The method of claim 1, wherein the carbon source is a carbohydrate carbon source or glycerol.

6. The method of claim 2, wherein the alcohol is one or more of methanol, ethanol, propanol, butanol, pentanol, hexanol, heptanol, octanol, decanol, dodecanol, tetradecanol and hexadecanol.

7. The method of claim 1, wherein the fadE gene of the recombinant bacterial host cell is attenuated.

8. The method of claim 1, wherein said glycine 395 is replaced with a basic amino acid.

9. The method of claim 8, wherein said glycine 395 is replaced with a lysine residue or an arginine residue.

10. The method of claim 1, wherein said exogenous gene encodes a polypeptide comprising SEQ ID NO: 18 having an amino acid substitution at glycine 395.

11. The method of claim 10, wherein said glycine 395 is replaced with a basic amino acid.

12. The method of claim 11, wherein said glycine 395 is replaced with a lysine residue or an arginine residue.

* * * * *